United States Patent 11,602,557 (BUNYAVIRALES VACCINE) - sequence listing, part 15

SEQ ID NO: 16869 - RNA, 1989 nt, Artificial Sequence
  derived and/or modified CDS sequence (wt) from CCHVF(10200)__U39455.2__IgE-leader_Gc
auggacuggaccuggauccuguuccucguggccgccgcgacccgcguccacagcuuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuag

SEQ ID NO: 16870 - RNA, 1449 nt, Artificial Sequence
  derived and/or modified CDS sequence (opt4) from CCHFV(10200)__NC_005302.1/U88410.1__N
auggagaacaagaucgaggugaacaacaaggacgagaugaacagaugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggacgugcccaagaucgagcagcugaccggcuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagccacgagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcaucuucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagagcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgaggugcagaagaccggcuucaacauccaggacauggacaucguggccagcgagcaucugcugcaccagagccuggugggcaagcagagccccuuccagaacgccuacaacgugaagggcaacgccaccagcgccaacaucaucuga

SEQ ID NO: 16871 - RNA, 1449 nt, Artificial Sequence
  derived and/or modified CDS sequence (opt4) from CCHFV(Turkey-Kelkit06)__GQ337053.1__N
auggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaaggacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcccaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcgagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccaggagaccggcuucaacauccaggacauggacaucguggccagcgagcaucugcugcaccagagcaucgugggcaagcagagccccuuccagaacgccuacaacgugaagggcaacgccaccagcgccaacaucaucuga

SEQ ID NO: 16872 - RNA, 5055 nt, Artificial Sequence
  derived and/or modified CDS sequence (opt4) from CCHFV(10200)__U39455.2__GP
augcacaucagccugauguacgccauccugugccugcagcugugcggccugggcgagacccacggcagccacaacgagaccagacacaacaagaccgacaccaugaccacccacggcgacaaccccagcagcgagccccccgugagcaccgcccugagcaucacccuggaccccagcaccgugacccccaccacccccgccagcggccuggagggcagcggcgagguguacaccagcccccccaucaccaccggcagccugccccugagcgagaccacccccgagcugcccgugaccaccggcaccgacacccugagcgccggcgacguggaccccagcacccagaccgccggcggcaccagcgcccccaccgugagaaccagccugcccaacagccccagcacccccagcaccccccaggacacccaccaccccgugagaaaccugcugagcgugaccagccccggccccgacgagaccagcacccccagcggcaccggcaaggagagcagcgccaccagcagcccccaccccgugagcaacagaccccccaccccccccgccaccgcccagggccccaccgagaacgacagccacaacgccaccgagcaccccgagagccugacccagagcgccacccccggccugaugaccagccccacccagaucgugcacccccagagcgccacccccaucaccgugcaggacacccaccccagccccaccaacagaagcaagagaaaccugaagauggagaucauccugacccugagccagggccugaagaaguacuacggcaagauccugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccccgccggccugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacagccuggacaucgacggcgccgugagacugccccacaucuaccacgagggcguguucauccccggcaccuacaagaucgugaucgacaagaagaacaagcugaacgacagaugcacccuguucaccgacugcgugaucaagggcagagaggugagaaagggccagagcgugcugagacaguacaagaccgagaucagaaucggcaaggccagcaccggcuucagaagacugcugagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcuga

SEQ ID NO: 16873 - RNA, 5055 nt, Artificial Sequence
  derived and/or modified CDS sequence (opt4) from CCHFV(IbAr10200)__AF467768.2__GP
augcacaucagccugauguacgccauccugugccugcagcugugcggccugggcgagacccacggcagccacaacgagaccagacacaacaagaccgacaccaugaccacccccggcgacaaccccagcagcgagccccccgugagcaccgcccugagcaucacccuggaccccagcaccgugacccccaccacccccgccagcggccuggagggcagcggcgagguguacaccagcccccccaucaccaccggcagccugccccugagcgagaccacccccgagcugcccgugaccaccggcaccgacacccugagcgccggcgacguggaccccagcacccagaccgccggcggcaccagcgcccccaccgugagaaccagccugcccaacagccccagcacccccagcaccccccaggacacccaccaccccgugagaaaccugcugagcgugaccagccccggccccgacgagaccagcacccccagcggcaccggcaaggagagcagcgccaccagcagcccccaccccgugagcaacagaccccccaccccccccgccaccgcccagggccccaccgagaacgacagccacaacgccaccgagcaccccgagagccugacccagagcgccacccccggccugaugaccagccccacccagaucgugcacccccagagcgccacccccaucaccgugcaggacacccaccccagccccaccaacagaagcaagagaaaccugaagauggagaucauccugacccugagccagggccugaagaaguacuacggcaagauccugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccccgccggccugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacagccuggacaucgacggcgccgugagacugccccacaucuaccacgagggcguguucauccccggcaccuacaagaucgugaucgacaagaagaacaagcugaacgacagaugcacccuguucaccgacugcgugaucaagggcagagaggugagaaagggccagagcgugcugagacaguacaagaccgagaucagaaucggcaaggccagcaccggcagcagaagacugcugagcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaagggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacaggugggcgaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcggcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacagaagaaucgccgagcuguucagcaccaagacccacaucggcuga

SEQ ID NO: 16874 - RNA, 5067 nt, Artificial Sequence
  derived and/or modified CDS sequence (opt4) from CCHFV(Turkey-Kelkit06)__GQ337054.1__GP
augcccaccaacaucaugcacaccccccuggugugcuucauccuguaccugcagcugcugugccugggcggcgcccacggccagcugaacgccaccgagcacaacggcaccaacaacaccaccgcccccggcgccagccagagccccaagccccccaugagcaccacccccccccacgcccccgagagcagcaccaucaagcccaccacccccaucagcgaggccgagggcagcggcgagaccaccagcccccccaacaccacccagggccugagcagccccgagaccaccagcgagagacccgccaccaccagcaucagcaccagcagcaccgacagcaccaaccccaccacccagaugaccgacaacacccccacccccaccgugagcaccagccccagcagcagccccagcacccccagcaccccccagggcauccaccaccccgccagaagccugcugagcgugagcagccccaagaccgugaccacccccacccccaccagccccggcgagaugagcagcgagaccagcagccagcacagcgccaugagcagaauccccaccccccacaccgccaccagagugagcaccgagaucaccaaccacagaacccccagacagagcgagagcagcgcccagcagaccacccccagccccaugaccagccccgcccagagcauccugcugaugagcgccgcccccaccgccgugcaggacauccaccccagccccaccaacagaagcaagagaaaccuggagaccgagaucauccugacccugagccagggccugaagaaguacuacggcaagauccugaagcugcugcaccugacccuggagcaggacaccgagggccugcuggaguggugcaagggcaaccugggcagcaacugcgacgacgacuucuuccagaagagaaucgaggaguucuucaugaccggcgagugcuacuucaacgaggugcugcaguucaagacccugagcacccugagccccaccgagcccagccacgccagacugcccaccgccgagcccuucaagagcuacuucgccaagggcuuccugagcaucgacagcggcuacuucagcgccaagugcuaccccagaagcagcgccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcuucagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagaguuucaagcugugcaagaacagcgccaccggcaagaccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcagaauggccaucuacaucugcagaaugagcaaccaccccagaaccaccauggccuuccuguucugguucagcuucggcuacgugaucaccuguaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggucagcgagagcaccggcguggcccugaagagaagcagcuggcugaucgugcugcuggugcugcugaccgugagccugagccccgugcagagcgcccccgugggccacggcaagaccaucgagaucuaccagaccagagagggcuucgccagcaucugccuguucaugcugggcagcauccuguucaucgugagcugccuggugaagggccugguggacagcgugagcgagagcuucuuccccggccugagcgugugcaagaccugcagcaucggcagcgugaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagggcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggugcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccuguaccggcgacugccccgagagaugcggcugcaccagcagcaccugucugcacaaggaguggagccacagcagaaacuggagaugcaaccccaccuggugcuggggcgugggcaccggcugcaccuguugcggcguggacgugaaggaccuguucaccgaccacauguucgugaaguggaagguggaguacaucaagaccgaggccaucgugugcguggcccugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcaggucuaccacaucggcaaccugcugaagggcgacagagugaacggccaccugauccacaagaucgagagccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcggcaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagaguagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccagacuggagcagccccagagcauccugaucgagcacaagggcaccaucaucggcaagcagaacgacaccuguaccgccaaggccagcugcuggcuggagagcgugaagaguuucuucuacggccugaagaacaugcugggcagcguguucggcaaccuguucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgacagacuggccgacagaaagaucgccgagcuguucagcaccaagacccacaucggcuga

SEQ ID NO: 16875 - RNA, 3579 nt, Artificial Sequence
  derived and/or modified CDS sequence (opt4) from CCHVF(10200)__U39455.2__SP-GP_Gn-NSm-Gc
augcacaucagccugauguacgccauccugugccugcagcugugcggccugggcgagacccacggcagccacaacgagaccagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcuga

SEQ ID NO: 16876 - RNA, 3552 nt, Artificial Sequence
  derived and/or modified CDS sequence (opt4) from CCHVF(10200)__U39455.2__IgE-leader_Gn-NSm-Gc
auggacuggaccuggauccuguuccugguggccgccgccaccagagugcacagcagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcuga

SEQ ID NO: 16877 - RNA, 2973 nt, Artificial Sequence
  derived and/or modified CDS sequence (opt4) from CCHVF(10200)__U39455.2__IgE-leader_Gn-4aa-Gc
auggacuggaccuggauccuguuccugguggccgccgccaccagagugcacagcagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggcagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcuga

SEQ ID NO: 16878 - RNA, 1029 nt, Artificial Sequence
  derived and/or modified CDS sequence (opt4) from CCHVF(10200)__U39455.2__IgE-leader_Gn
auggacuggaccuggauccuguuccugguggccgccgccaccagagugcacagcagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggcuga

SEQ ID NO: 16879 - RNA, 1989 nt, Artificial Sequence
  derived and/or modified CDS sequence (opt4) from CCHVF(10200)__U39455.2__IgE-leader_Gc
auggacuggaccuggauccuguuccugguggccgccgccaccagagugcacagcuuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcuga

SEQ ID NO: 16880 - RNA, 1449 nt, Artificial Sequence; identical to SEQ ID NO: 5950
  derived and/or modified CDS sequence (opt3) from CCHFV(10200)__NC_005302.1/U88410.1__N

SEQ ID NO: 16881 - RNA, 1449 nt, Artificial Sequence; identical to SEQ ID NO: 5951
  derived and/or modified CDS sequence (opt3) from CCHFV(Turkey-Kelkit06)__GQ337053.1__N

SEQ ID NO: 16882 - RNA, 5055 nt, Artificial Sequence; identical to SEQ ID NO: 10252
  derived and/or modified CDS sequence (opt3) from CCHFV(10200)__U39455.2__GP

SEQ ID NO: 16883 - RNA, 5055 nt, Artificial Sequence; identical to SEQ ID NO: 10253
  derived and/or modified CDS sequence (opt3) from CCHFV(IbAr10200)__AF467768.2__GP

SEQ ID NO: 16884 - RNA, 5067 nt, Artificial Sequence; identical to SEQ ID NO: 10254
  derived and/or modified CDS sequence (opt3) from CCHFV(Turkey-Kelkit06)__GQ337054.1__GP

SEQ ID NO: 16885 - RNA, 3579 nt, Artificial Sequence
  derived and/or modified CDS sequence (opt3) from CCHVF(10200)__U39455.2__SP-GP_Gn-NSm-Gc
augcacaucagccugauguacgccauucucugccuucagcuguguggcuugggggagacccauggaucccacaacgaaacaucugaggaacccucagacgauugcgugaguagaacucaauuacugaggacggagaccgcugaaauacauggugacaauuauggcgggccuggagauaagaucacaauuuguaacggcagcacuaucgucgaccagcggcuagguuccgagcucgggugcuacaccauuaaucgcguucgaucuuucaaacugugugagaacucggcaacaggaaagaauugcgaaaucgauucagugccaguaaaaugucgucagggcuauugccuuagaauaacccaggagggcagggggcacgugaagcugagccggggaagugaagucguguuggacgccugugauacuuccugcgagaucaugauuccgaaagguacaggcgacauccucguugauuguucugggggacaacagcauuuucugaaggacaaccugauugaucucggcugccccaagaucccuuuacuggguaaaauggcgauauacauuugccgcaugagcaaucacccaaagaccacgauggcuuucuuguuuugguucuccuuuggguaugugaucacuuguauucuuugcaaagccaucuucuaccugcuaaucauugucggaacccucggcagaaggcugaagcaguaucgggagcuuaaaccccagacauguacuauaugcgaaaccacaccugugaacgcaaucgacgccgagaugcacgaucugaauuguucauacaacauuugcccauacugugcuagucgcuugaccagcgacggccucgcacgacauguaauccaaugccccaagagaaaggaaaaaguugaggaaacggagcuguauuuaaaucuggagaggauaccuugggugguccggaagcuccuucaggugucugaauccacugggguggcccugaaacguucaagcugguugauuguccuacugguucucuuuacagugagucugucuccaguacaguccgcuccgaucggacaggguaagaccaucgaggccuaccgcgcgagagaaggcuauacuagcauuugucuuuucgugcuggggucgaucuuguuuauugucucuugccucaugaaaggacugguggacuccguuggcaacucauucuuucccgguuuaaguauauguaagacaugcagcaucuccucuauuaauggguucgagaucgaaagccacaaaugcuacuguucacuguuuugcuguccuuauugcaggcauuguaguaccgauaaggagauccacaagcuacaccucuccauuugcaaaaagcggaaaacgggcagcaacgugaugcuggcagucuguaaacuuaugugcuuccgagccaccauggaggugucuaaucgcgcuuuguucauaagaucaaucauuaacacaacuuuuguacuguguauccucauucuggccguuugcguggucaguaccagcgcaguggaaauggagaaccuuccagcuggaacaugggaaagggaggaagaccugacuaauuucugucaucaagagugccaggucaccgagacagaaugcuugugucccuacgaggcccucgugcugcggaaaccuuuauuucuggauuccaccgcgaagggcaugaagaaccuacucaauucuacuucgcuggaaacgagccuuuccaucgaggccccauggggagcaauaaacguucagucaacauauaaacccaccgugaguacugcuaauaucgccuugucuuggagcuccguagagcaccgcgggaacaagauucuggucucagguagaagcgaaucuaucaugaaacucgaggaaaggaccggcauuuccugggaccuggggguggaggaugcuagugaaagcaaguuacugacaguuucugugauggaccuuucccaaauguacucaccggucuucgaguacuugaguggagaucgucagguggaggaauggccuaaagcaaccugcacuggcgacugucccgagcggugcgguuguacaagcucgacgugccuccauaaggaauggccacacucccgaaauuggagauguaacccuaccuggugcuggggcguagggacuggauguacaugcuguggccuggaugugaaggaccuauuuaccgauuauauguucguuaaauggaaggucgaguacaucaaaacagaagccauagugugcguggagcugacuucucaggagaggcagugcagccucauugaagccgggacccgcuuuaaucugggacccgucacgaucacccuuucagagccacggaacauucaacagaaguugcccccugaaaucauaacacugcauccaagaaucgaggaagguuucuuugacuuaaugcacguucagaaagugcucagugcuuccacuguguguaagcugcagucuugcacccacggcguaccgggggaccuucaagucuaucauauuggaaaucuguugaagggcgauaaagugaacggucaccucauccauaagauugagccccacuucaauacaagcuggauguccugggacgggugugaucuggacuacuauugcaacaugggcgauuggccuucauguacuuacaccggaguuacgcagcacaaucaugcgagcuuugugaaccuacugaacaucgagacagacuauaccaaaaauuuccacuuucauaguaagagggucacugcacacggcgauacaccacagcucgaccugaaagcccgccccaccuacggggcuggagaaauaacugugcuuguugagguggccgauauggaauugcauaccaagaaaauugagaucucuggccugaaguucgcauccuuagccugcacagguuguuacgcuugcagcucgucaaucucuuguaagguacggauucacgucgacgagccugaugaacucacggugcacgugaaaagugacgauccagacgucguugccgcauccagcucucugauggcgcgaaaacuugaguucgggaccgacagcacuuuuaaggcuuucuccgccaugcccaagacaucacugugcuuuuauaucguggaacgugagcauuguaagaguugcagcgaagaggauaccaagaagugcguaaacacaaaacuagagcagccgcaaucuauucucauagaacacaagggaacuaucauuggcaaacagaauagcaccuguacggcaaaggccucaugcuggcuggagagugugaaauccuucuuuuacgguuugaagaacaugcuguccggcaucuucgggaaugucuuuaugggaauuuucuuauuucucgcuccuuucauccugcuuauacuguuuuucauguuuggcuggagaaucuuguucuguuucaagugcuguaggcgcacacgggggcucuuuaaauauagacaucugaaggacgaugaagagaccggauacaggcgaauuaucgaaaaacuaaacaauaagaaaggcaagaacaagcugcuugacggugagcgccucgccgaugggcggauugcagagcuguucucuacuaaaacccacaucggauga

SEQ ID NO: 16886 - RNA, 3552 nt, Artificial Sequence
  derived and/or modified CDS sequence (opt3) from CCHVF(10200)__U39455.2__IgE-leader_Gn-NSm-Gc
auggacuggaccuggauccuguuccucguggccgcugcaacaagaguccacagcuccgaggaacccucugaugacugcguuucaaggacucagcuucugcggacggagaccgccgaaauucauggcgauaacuacgggggaccuggugacaagauaacaaucuguaauggcaguacuauuguggaucaacgcuuggggagcgaguuaggaugcuauaccaucaaccgaguacguuccuuuaaacugugugaaaauucugcgacaggcaagaacugcgagauugacucggugccagucaaauguagacaggguuacugccuaaggaucacccaggaggggcggggacacgugaagcucucacgcggcagcgaaguugugcuggaugcuugugacaccaguugcgagauaaugaucccgaaaggcacaggggauauucuugucgacuguuccggaggucagcaacauuuccugaaggauaauuugaucgaccucggcugccccaagauuccucugcuggggaaaauggccaucuauauauguagaaugucuaaccacccaaagaccacgauggcauuucucuucugguuuagcuucggauacgugauuacuugcaucuuaugcaaagccaucuuuuaucugcuuauuaucguaggcaccuuggguaggcggcugaagcaguaccgcgaacuaaaaccccagacauguacuauuugcgagaccacaccuguuaaugcuauagaugcagagaugcaugaccucaacuguuccuauaauaucugcccauacugugccucacgacugaccagugacgggcuugcuagacacgugauucagugccccaagaggaaggaaaaagucgaggaaacggagcuguacuugaaccucgaacggaucccuuggguggugcguaagcuguuacaagucagcgagucuacuggaguugcccugaaacgcuccucauggcucauagugcuucugguauuguucacagugagccuaaguccaguccagucugcgccgauuggccagggcaagaccaucgaggcauauagagccagggaaggguacacuuccaucugucuguuugugcucggaagcauucuguucaucguuucgugccuuaugaaaggucugguggauucugucggcaauuccuuuuuccccggguugucaauuuguaagacaugcaguauaagcuccaucaacggauuugagauugaaucucacaaauguuauugcagccucuucugcuguccuuacugccggcauuguucaaccgacaaggagauccacaagcugcauuuaaguaucugcaaaaagcgaaaaacgggcuccaaugugaugcuggcuguauguaagcuaaugugcuuccgcgccaccauggaaguuagcaacagagcacucuuuauuaggucuauaaucaauacaacuuucgugcuguguauucuuaucuuggcugucugcguggucucaaccagugccguggagauggagaaccugccagcggguacaugggaacgggaggaagaucucacuaacuuuugucaccaggagugccaaguuaccgaaacagagugucugugccccuaugaggcccuugugcugcgcaaaccuuuguuccucgacagcaccgcaaaggggaugaagaaucuguuaaacuccacuucucuggaaacgucgcuaagcauugaggcuccauggggcgccaucaauguacaguccacauacaaacccaccgucucaacugcuaacauagcccucaguuggucuagcguggaacacagaggaaauaagauccugguuuccggcaggucagagagcauuaugaaacuugaggaacguaccgggaucucuugggauuugggaguggaggacgcauccgaaaguaagcugcucacagucagcgugauggaucugucucagauguauuccccgguauuugaguacuuaucaggugaccggcaaguggaagaguggccuaaagccacuugcacuggcgauugucccgagcgaugcggguguacaaguagcacgugccugcauaaggaauggccacacucgagaaacuggagguguaauccuaccuggugcuggggaguuggcacugguuguacaugcugugggcuugacgucaaggauuuguucaccgacuacauguuugugaaauggaagguggaguauauuaaaacagaagcuaucgucugcguugagcucacuucccaggaacgccaguguucucugauagaggcgggcacccgguucaaccuaggacccgugacgauuacccugagcgagccaagaaauauccagcaaaagcugcccccugaaauuaucacacuccauccaaggauagaggaaggcuuuuucgaccuuaugcacgugcagaaaguauugucagcaaguacugucugcaagcugcaguccugcacccauggggugccgggagauuuacagguuuaccacaucgguaaccuccugaagggcgacaaagugaaugggcaccuuauucauaagaucgagccccacuuuaacacaucuuggaugagcugggauggaugugaccuggauuauuacugcaauaugggcgacuggccuuccuguacuuauaccggugucacgcaacauaaccacgccucauucgugaauuugcucaacauugaaacagauuacaccaaaaacuuucacuuccauagcaagcgcguuacugcucacggggacacaccacagcuggaucuaaaagcccgacccaccuauggcgcaggagagaucacugugcugguagaggucgccgacauggaacuccauaccaagaaaauagagauuaguggccugaaguucgcuucucuugccugcacaggguguuacgcaugcuccagcucgaucucauguaaggugcggauccacguggaugaaccugacgaguugacgguccauguuaaaucugaugacccagacgugguagcggcuaguuccagccugauggcccguaaguuagaguuuggaaccgauucuacuuucaaagcauuuagcgccaugcccaagacaucccucugcuucuacauuguggaaagagagcacuguaaaucaugcagugaagaggacaccaagaagugugucaauacaaaacuggaacagccgcagagcauccuuauugagcacaagggcacuauaaucgguaaacaaaacucuaccugcacggcuaaggccuccugcuggcuggagucagugaaaaguuucuuuuaugggcuaaagaauaugcucagcggaauuuuuggcaacguuuucauggguaucuuucuguucuuggcaccuuuuauucuguuaauccucuucuuuauguucggcuggaggauacuguucuguuuuaagugcugucgccggacaagagggcuuuucaaauacaggcaucugaaggaugacgaagagaccggauaucgacgcaucauugaaaaauugaauaacaagaaaggcaagaauaagcuccuggauggggagcggcuagcugacggaagaaucgccgaacuguuuuccacuaaaacccacauuggcuga

SEQ ID NO: 16887 - RNA, 2973 nt, Artificial Sequence
  derived and/or modified CDS sequence (opt3) from CCHVF(10200)__U39455.2__IgE-leader_Gn-4aa-Gc
auggacuggaccuggauccuguuccucguggccgcugcaacaagaguccacagcuccgaggaacccucugaugacugcguuucaaggacucagcuucugcggacggagaccgccgaaauucauggcgauaacuacgggggaccuggugacaagauaacaaucuguaauggcaguacuauuguggaucaacgcuuggggagcgaguuaggaugcuauaccaucaaccgaguacguuccuuuaaacugugugaaaauucugcgacaggcaagaacugcgagauugacucggugccagucaaauguagacaggguuacugccuaaggaucacccaggaggggcggggacacgugaagcucucacgcggcagcgaaguugugcuggaugcuugugacacaaguugcgagauaaugaucccgaaaggcacaggggauauucuugucgacuguuccggaggucagcaacauuuccugaaggauaauuugaucgaccucggcugccccaagauuccucugcuggggaaaauggccaucuauauauguagaaugucuaaccacccaaagaccacgauggcauuucucuucugguuuagcuucggauacgugauuacuugcaucuuaugcaaagccaucuuuuaucugcuuauuaucguaggcaccuuggguaggcggcugaagcaguaccgcgaacuaaaaccccagacauguacuauuugcgagaccacaccuguuaaugcuauagaugcagagaugcaugaccucaacuguuccuauaauaucugcccauacugugccucacgacugaccagugacgggcuugcuagacacgugauucagugccccaagaggaaggaaaaagucgaggaaacggagcuguacuugaaccucgaacggaucccuuggguggugcguaagcuguuacaagucagcgagucuacuggaguugcccugaaacgcuccucauggcucauagugcuucugguauuguucacagugagccuaaguccaguccagucugcgccgauuggcagaaagccccuguuucucgauuccaccgcaaaaggcaugaagaaucugcuuaacagcacuucgcuggagacaucuuuguccaucgaagccccuuggggagcuaucaaugugcagucaaccuauaaaccaacgguuaguaccgccaacauugcacucagcugguccucuguggagcacagggggaauaagauccuggucagcggucggucagaaaguauuaugaaguuagaggaacgaacaggcauauccugggaccuggggguggaggaugcuagcgagucuaaacuacucacuguaucaguuauggaccugagucagauguacagccccguguucgaauaucuuuccggagaucgccaagucgaggaauggccuaaggccaccuguacaggcgacugcccagagagaugugguugcacuucuucgaccuguuugcauaaagaauggccccacagcaggaacuggcggugcaacccgacauggugcuggggcguggggaccggauguacuugcuguggccuggaugucaaggaccucuuuacggauuacauguucgugaaauggaagguugaguauaucaagacagaggcgauugugugcguagaacugaccucccaggagcgccaguguucacuuaucgaagccgggacuagauuuaaucugggaccugucaccaucacauugagugagcccaggaacauucaacagaaacucccaccugagauaaucacccugcauccccguauugaagaggguuucuucgacuuaaugcacgugcagaagguucugucugcaagcacugugugcaaacuacaguccuguacacacggcgucccaggggaucuccaaguguaccauaucggaaaucugcuuaagggcgacaaaguaaacggucacuugauucauaagaucgaaccccacuuuaauacgucauggaugagcugggacgggugcgaucuggacuauuacuguaacaugggcgauuggccuucuugcaccuacacuggagugacacagcauaaucacgcuuccuucguuaaccuccugaauauagagaccgacuauacaaagaacuuucacuuccauaguaaacgggucacugcccacggcgauaccccacaguuagaccugaaggcucgaccgacguacggggccggagaaaucaccgugcuuguggaggucgcagauauggaguugcauacuaaaaagauugaaaucagcggucucaaauuugccucucuggcuuguacuggcugcuaugcgugcuccucaaguauuagcuguaagguuagaauccacguggacgagcccgaugaacuaaccgugcacguaaagucggacgauccugacgucguggcagccuccucuagccugauggcuaggaaacucgaguucgggacagauucaacuuuuaaggccuucagugcaaugccaaaaaccucccugugcuuuuacauaguugaacgcgagcauuguaagucuugcagcgaggaagacacgaaaaagugugugaauacaaaacuugagcagccccaauccauuuugaucgaacacaagggaaccauuaucggcaagcagaacucaacuugcacagccaaagcuagcuguuggcuggagagugucaagucuuucuuuuauggucucaaaaauauguuauccgggauauucggcaacguguuuaugggaaucuuccuguuccuugccccuuuuauucuguugauccucuucuuuauguucggcuggcggauucuguuuugcuucaaguguugcagaaggacccgcgggcuauuuaaauaccgacaucugaaggacgaugaagagacuggauaucggcguaucauagagaagcucaauaacaaaaagggcaaaaacaagcugcuugacggugaaagauuggcagaugggaggauugcggagcuguucagcaccaaaacacacaucggauga

SEQ ID NO: 16888 - RNA, 1029 nt, Artificial Sequence
  derived and/or modified CDS sequence (opt3) from CCHVF(10200)__U39455.2__IgE-leader_Gn
auggacuggaccuggauccuguuccucguggccgcugcaacaagaguccacagcuccgaggaacccucugaugacugcguuucaaggacucagcuucugcggacggagaccgccgaaauucauggcgauaacuacgggggaccuggugacaagauaacaaucuguaauggcaguacuauuguggaucaacgcuuggggagcgaguuaggaugcuauaccaucaaccgaguacguuccuuuaaacugugugaaaauucugcgacaggcaagaacugcgagauugacucggugccagucaaauguagacaggguuacugccuaaggaucacccaggaggggcggggacacgugaagcucucacgcggcagcgaaguugugcuggaugcuugugacacaaguugcgagauaaugaucccgaaaggcacuggggauauucuugucgacuguuccggaggucagcaacauuuccugaaggauaauuugaucgaccucggcugccccaagauuccucugcuggggaaaauggccaucuauauauguagaaugucuaaccacccaaagaccacgauggcauuucucuucugguuuagcuucggauacgugauuacuugcaucuuaugcaaagccaucuuuuaucugcuuauuaucguaggcaccuuggguaggcggcugaagcaguaccgcgaacuaaaaccccagacauguacuauuugcgagaccacaccuguuaaugcuauagaugcagagaugcaugaccucaacuguuccuauaauaucugcccauacugugccucacgacugaccagugacgggcuugcuagacacgugauucagugccccaagaggaaggaaaaagucgaggaaacggagcuguacuugaaccucgaacggaucccuuggguggugcguaagcuguuacaagucagcgagucuacuggaguugcccugaaacgcuccucauggcucauagugcuucugguauuguucacagugagccuaaguccaguccagucugcgccgauuggcuga

SEQ ID NO: 16889 - RNA, 1989 nt, Artificial Sequence
  derived and/or modified CDS sequence (opt3) from CCHVF(10200)__U39455.2__IgE-leader_Gc
auggacuggaccuggauccuguuccucguggccgcugcaacaagaguccacagcuuucuugauuccacugccaagggcaugaaaaaccuguuaaauucuacgucauuggagaccagucugagcauugaagcgcccuggggagcuauaaacguucaguccacauacaagccuacugugucuaccgccaauaucgcacuaucguggucaagcguagagcauagggggaacaaaauucucgugaguggucgguccgaaucuaucaugaagcuggaggaacgcacaggcauuagcugggaccuuggggucgaggaugccuccgagucaaaacuguugaccgugaguguuauggaccucagccagauguauucuccaguguucgaauaccuguccggagaucgacaggucgaggaauggccgaaggcuacuugcacaggcgacugucccgagcguugcgguuguaccucaagcacgugccugcacaaggaguggccucauaguagaaauuggagguguaacccaacuuggugcuggggaguggggaccggcuguacaugcuguggccucgauguaaaagacuuauuuacugauuauauguucguuaaguggaaaguggaauacaucaagaccgaggcaauagucugcguggaacugacaucucaggagcggcaguguucccuuaucgaagccgggacccgcuuuaauuugggacccgugacgauuacucugagcgagccuagaaacauccaacagaaacuaccacccgagauuaucacacuccacccuaggauagaagaggguuucuuugaccugaugcauguccagaagguucuuucggcuucuaccgugugcaagcugcaguccugcacucacggcguaccaggggauuugcaaguguaucacauuggaaaucuccugaaaggcgacaaggucaacggucauuuaauccacaaaauugaaccgcauuucaauacaucauggaugaguugggaugggugugaccuggacuacuauugcaacaugggagauuggcccagcuguaccuacacgggcgugacccagcacaaucacgccuccuuuguuaaccuccuuaauaucgagacagacuacacuaagaacuuccauuuucacucuaaacgggugaccgcgcauggcgauacaccucagcuggacuugaaggcacgcccaacuuauggggccggagaaaucaccguccuaguggagguagcugauauggagcugcacaccaaaaagauugaaauaagcggucucaaguucgccucacuggcaugcacaggcuguuacgcuugcaguuccagcaucucuuguaaaguucgaauccauguggacgagcccgaugaacuuacuguccacgugaagucagacgauccugacgucguggccgcgaguagcucccugauggccagaaaauuggaguuugggacggauucuacauucaaggcauucucggcuaugccaaaaaccagccucugcuuuuauauuguugaaagggagcacuguaaguccugcucagaggaagacacuaagaaaugugugaacaccaagcuggagcagccccaaaguauauuaauugaacauaaaggaacaaucaucggcaagcaaaauucuaccugcacugccaaagcuagcugcuggcuggaguccguaaagucauucuuuuacggucuaaagaacaugcucagcgggauuuucggcaaugucuuuaugggaaucuuccuguuucuugccccguucauuuugcugauacucuuuuucauguuuggcuggcggauccuguucuguuuuaaaugcugucgucgcacaagagggcuuuucaaguauaggcaccugaaagacgaugaggaaacgggauaccggcgaauuaucgagaaguugaacaauaaaaaggguaagaacaaacuccuggacggcgaacgcuuagcagaugggagaaucgccgagcuguucucuaccaagacucauauuggauga

SEQ ID NO: 16890 - RNA, 1449 nt, Artificial Sequence; identical to SEQ ID NO: 6642
  derived and/or modified CDS sequence (opt1) from CCHFV(10200)__NC_005302.1/U88410.1__N

SEQ ID NO: 16891 - RNA, 1449 nt, Artificial Sequence; identical to SEQ ID NO: 6643
  derived and/or modified CDS sequence (opt1) from CCHFV(Turkey-Kelkit06)__GQ337053.1__N

SEQ ID NO: 16892 - RNA, 5055 nt, Artificial Sequence
  derived and/or modified CDS sequence (opt1) from CCHFV(10200)__U39455.2__GP
augcacaucagccugauguacgccauccucugccugcagcugugcggccucggggagacccacggcucccacaacgagacccgccacaacaagacggacaccaugaccacccacggggacaaccccagcuccgagccgcccgugagcacggcccuguccaucacccuggaccccagcaccgucacccccacgaccccggcguccggccucgaggggagcggcgagguguacaccuccccgcccaucaccacgggcagccugccccuguccgagaccacccccgagcuccccgugaccacggggaccgacacccugagcgccggcgacgucgaccccuccacccagacggccgggggcaccagcgcccccaccgugcggaccucccugccgaacagccccuccacgcccagcacgccccaggacacccaccacccggugcgcaaccuccuguccgucaccagccccgggcccgacgagaccagcacccccuccggcaccggcaaggagagcuccgccaccagcuccccgcaccccgugagcaaccggccgcccacgccgcccgcgaccgcccaggggcccaccgagaacgacucccacaacgccaccgagcaccccgagagccugacgcaguccgccacccccggccucaugaccagccccacccagaucgugcacccccaguccgcgaccccgaucacgguccaggacacccaccccagccccaccaaccgcuccaagcggaaccugaagauggagaucauccugacccucagccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgcccggcacccucuccaccaccgagagcacgccggccgggcugcccaccgccgagcccuucaaguccuacuucgccaagggcuuccugagcaucgacuccggcuacuacagcgccaagugcuacagcgggaccuccaacagcggccuccagcugaucaacaucacccgccacuccacgcggaucguggacacccccgggccgaagaucaccaaccugaagaccaucaacugcaucaaccucaaggcgagcaucuucaaggagcaccgcgaggucgagaucaacgugcugcugccccagguggccgucaaccucuccaacugccacguggugaucaagagccacgucugcgacuacucccuggacaucgacggcgccgugcggcugccccacaucuaccacgaggggguguucauccccggcacguacaagaucgucaucgacaagaagaacaagcucaacgaccgcugcacccuguucaccgacugcgugaucaagggccgggaggugcgcaaggggcagagcguccugcggcaguacaagaccgagauccgcaucggcaaggccuccacgggguuccggcgccuccugagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcagggcaagaccaucgaggccuaccgggcccgcgagggguacaccuccaucugccucuucguccugggcagcauccuguucaucguguccugccucaugaaggggcugguggacagcgucggcaacuccuucuuccccggccugagcaucugcaagacgugcagcaucuccagcaucaacggguucgagaucgagucccacaagugcuacugcagccucuucugcugcccguacugccggcacugcuccaccgacaaggagauccacaagcugcaccugagcaucugcaagaagcgcaagaccggcuccaacgugaugcucgccgugugcaagcugaugugcuuccgcgcgaccauggaggucagcaaccgggcccuguucauccgcuccaucaucaacacgaccuucgugcucugcauccugauccuggccgugugcgucgugagcaccuccgccguggagauggagaaccuccccgccgggaccugggagcgggaggaggaccugacgaacuucugccaccaggagugccaggucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucggguga

SEQ ID NO: 16893 - RNA, 5055 nt, Artificial Sequence
  derived and/or modified CDS sequence (opt1) from CCHFV(IbAr10200)__AF467768.2__GP
augcacaucagccugauguacgccauccucugccugcagcugugcggccucggggagacccacggcucccacaacgagacccgccacaacaagacggacaccaugaccacccccggggacaacccgagcuccgagccgcccgugagcacggcccuguccaucacccuggaccccagcaccgucacccccacgacccccgcguccggccucgaggggagcggcgagguguacaccuccccgcccaucaccacgggcagccugccccuguccgagaccacccccgagcuccccgugaccacggggaccgacacccugagcgccggcgacgucgaccccuccacccagacggccgggggcaccagcgccccgaccgugcggaccucccugcccaacagccccuccacgcccagcaccccgcaggacacccaccaccccgugcgcaaccuccuguccgucaccagccccgggcccgacgagacgagcacccccuccggcaccggcaaggagagcuccgccaccagcuccccgcaccccgugagcaaccggcccccgacgccgcccgcgaccgcccaggggcccaccgagaacgacucccacaacgccaccgagcaccccgagagccugacgcaguccgccacccccggccucaugaccagccccacccagaucgugcacccgcaguccgcgacccccaucacgguccaggacacccaccccagccccaccaaccgcuccaagcggaaccugaagauggagaucauccugacccucagccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgccgggcacccucuccaccaccgagagcacgcccgccgggcugcccaccgccgagcccuucaaguccuacuucgccaagggcuuccugagcaucgacuccggcuacuacagcgccaagugcuacagcgggaccuccaacagcggccuccagcugaucaacaucacccgccacuccacgcggaucguggacaccccggggcccaagaucaccaaccugaagaccaucaacugcaucaaccucaaggcgagcaucuucaaggagcaccgcgaggucgagaucaacgugcugcugccccagguggccgucaaccucuccaacugccacguggugaucaagagccacgucugcgacuacucccuggacaucgacggcgccgugcggcugccccacaucuaccacgaggggguguucaucccgggcacguacaagaucgucaucgacaagaagaacaagcucaacgaccgcugcacccuguucaccgacugcgugaucaagggccgggaggugcgcaaggggcagagcguccugcggcaguacaagaccgagauccgcaucggcaaggccuccacggggagccggcgccuccuguccgaggagcccagcgacgacugcaucucccggacccagcugcuccgcaccgagaccgccgagauccacggcgacaacuacgggggccccggcgacaagaucacgaucugcaacgggagcaccaucguggaccagcgccugggcuccgagcuggggugcuacaccaucaaccggguccgcagcuucaagcugugcgagaacuccgcgaccggcaagaacugcgagaucgacagcgugcccgugaagugccggcagggcuacugccuccgcaucacgcaggaggggcggggccacgucaagcugagccgcggguccgagguggugcuggacgccugcgacaccagcugcgagaucaugaucccgaagggcaccggggacauccucgucgacugcuccggcggccagcagcacuuccugaaggacaaccugaucgaccucgggugccccaagaucccccugcugggcaagauggccaucuacaucugccggaugagcaaccaccccaagaccacgauggccuuccucuucugguucuccuucggguacgugaucacgugcauccugugcaaggccaucuucuaccugcucaucaucgugggcacccuggggaagcgccugaagcaguaccgggagcucaagccgcagaccugcaccaucugcgagacgacccccgucaacgcgaucgacgccgagaugcacgaccugaacugcagcuacaacaucugccccuacugcgccucccgccugaccagcgacggccucgcccggcacgugauccagugccccaagcgcaaggagaagguggaggagaccgagcuguaccugaaccucgagcggaucccgugggucgugcgcaagcugcugcaggucuccgagagcacgggcgucgcccucaagcgguccagcuggcugaucgugcugcucgugcuguucaccgucucccugagccccgugcaguccgcgcccaucgggcagggcaagaccaucgaggccuaccgcgcccgggagggguacaccagcaucugccucuucgugcugggcuccauccuguucaucgucagcugccucaugaaggggcugguggacuccgugggcaacagcuucuucccgggccugagcaucugcaagacgugcuccaucagcuccaucaacggguucgagaucgagagccacaagugcuacugcucccucuucugcugccccuacugccgccacugcagcaccgacaaggagauccacaagcugcaccuguccaucugcaagaagcggaagaagggcagcaacgucaugcucgccgugugcaagcugaugugcuuccgcgcgaccauggagguguccaaccgcgcccuguucauccggagcaucaucaacaccacguucguccucugcauccugauccuggccgugugcguggucuccaccagcgccguggagauggagaaccuccccgccgggaccugggagcgcgaggaggaccugaccaacuucugccaccaggagugccaggugacggagaccgagugccugugccccuacgaggcgcucguccugcggaagccgcuguuccucgacuccaccgccaagggcaugaagaaccugcugaacagcaccucccucgagacgagccuguccaucgaggcccccuggggcgccaucaacgugcagagcaccuacaagcccaccguguccaccgccaacaucgcgcugagcuggagcuccgucgagcaccgcgggaacaagauccucgugagcggccgguccgagagcaucaugaagcuggaggagcgcacggggaucuccugggaccugggcguggaggacgccagcgaguccaagcuccugaccgucagcgugauggaccugucccagauguacagccccguguucgaguaccucuccggggaccggcaggucggcgaguggccgaaggccacgugcaccggcgacugccccgagcgcugcgggugcacgagcuccacgugccugcacaaggaguggccccacagccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccucccaggagcggcagugcagccugaucgaggccggcacgcgcuucaaccucggcccggugaccaucacccuguccgagccccggaacauccagcagaagcugccgcccgagaucaucacccuccacccccgcaucgaggagggguucuucgaccugaugcacgugcagaagguccugagcgcguccaccgugugcaagcuccagagcugcacgcacggcguccccggggaccugcaggucuaccacaucggcaaccugcucaagggggacaaggugaacggccaccugauccacaagaucgagccccacuucaacaccagcuggauguccugggacggcugcgaccuggacuacuacugcaacaugggggacuggcccagcugcaccuacaccggcgucacgcagcacaaccacgccuccuucgugaaccuccugaacaucgagaccgacuacaccaagaacuuccacuuccacagcaagcgggugaccgcccacggggacacgccgcagcuggaccucaaggcccgccccaccuacggcgcgggggagaucaccguccugguggagguggccgacauggagcugcacaccaagaagaucgagaucuccggccucaaguucgccagccuggccugcacgggcugcuacgccugcuccagcgggaucuccugcaagguccggauccacguggacgagcccgacgagcugaccgugcacgucaagagcgacgaccccgacgugguggcggccuccagcucccucauggcccgcaagcuggaguucggcaccgacagcaccuucaaggccuucuccgccaugccgaagacgagccugugcuucuacaucgucgagcgggagcacugcaaguccugcagcgaggaggacaccaagaagugcgugaacaccaagcucgagcagccccaguccauccugaucgagcacaaggggaccaucaucggcaagcagaacagcacgugcaccgcgaaggccagcugcuggcuggaguccgugaaguccuucuucuacggccugaagaacaugcucuccgggaucuucggcaacgucuucauggggaucuuccuguuccuggcccccuucauccuccugauccuguucuucauguucggcuggcgcauccucuucugcuucaagugcugccggcgcacccgcgggcuguucaaguaccggcaccugaaggacgacgaggagaccggcuaccgccggaucaucgagaagcucaacaacaagaagggcaagaacaagcugcuggacggggagcgccucgccgaccggcgcaucgccgagcuguucagcacgaagacccacaucggcuga

SEQ ID NO: 16894 - RNA, 5067 nt, Artificial Sequence
  derived and/or modified CDS sequence (opt1) from CCHFV(Turkey-Kelkit06)__GQ337054.1__GP
augcccaccaacaucaugcacaccccgcuggugugcuucauccucuaccugcagcugcucugccugggcggggcccacggccagcugaacgccacggagcacaacgggaccaacaacaccaccgcgcccggcgccagccagucccccaagcccccgaugagcacgaccccgccccacgcccccgaguccagcaccaucaagccgaccacgcccaucuccgaggccgaggggagcggcgagaccaccuccccgcccaacaccacgcagggccucagcuccccggagaccaccagcgagcgccccgccaccacguccaucagcaccuccagcaccgacuccaccaaccccacgacccagaugaccgacaacacccccacgccgaccgucagcaccucccccagcuccagccccagcacccccuccacgccgcaggggauccaccaccccgcgcggagccugcuguccgugagcucccccaagaccgugaccacccccacgccgaccagccccggcgagauguccagcgagaccuccagccagcacuccgccaugagccgcauccccaccccgcacacggccacccgggucuccaccgagaucaccaaccaccgcaccccgcggcagagcgaguccagcgcccagcagacgacccccucccccaugaccagcccggcgcaguccauccuccugaugagcgccgcccccaccgccgugcaggacauccaccccagccccacgaaccgcuccaagcggaaccuggagaccgagaucauccucacccugagccaggggcugaagaaguacuacggcaagauccucaagcugcugcaccucacccuggagcaggacacggaggggcugcucgaguggugcaagggcaaccugggcuccaacugcgacgacgacuucuuccagaagcgcaucgaggaguucuucaugaccggggagugcuacuucaacgaggugcugcaguucaagacccucagcacccuguccccgacggagcccagccacgcccggcugcccaccgcggagcccuucaaguccuacuucgccaagggcuuccucagcaucgacuccggguacuucagcgccaagugcuacccgcgcuccagcgccuccggccugcagcugaucaacgucacccagcaccccgcccggaucgcggagacccccggccccaagacgaccagccucaagaccaucaacugcaucaaccugcgcgccuccguguucaaggagcaccgggagguggagaucaacguccugcucccgcagaucgccgugaaccugagcaacugccacguggucaucaacucccacgugugcgacuacagccuggacaccgacgggcccgugcgccucccccggaucuaccacgagggcacguucauccccgggaccuacaagaucgucaucgacaagaagaacaagcugaacgaccgcugcacccuggugaccaacugcgugaucaagggccgggagguccgcaaggggcagagcgugcuccggcaguacaagacggagaucaagaucggcaaggccuccaccggcuuccgcaagcugcugagcgaggagccgggggacgacugcaucucccggacccagcuccugcgcaccgagacggccgagauccacgacgacaacuacggcgggcccggcgacaagaucaccaucugcaacgggagcaccaucguggaccagcgccugggcuccgagcucggcugcuacaccaucaaccgggucaagagcuucaagcugugcaagaacuccgcgacggggaagaccugcgagguggacagcacccccgugaagugccgccagggcuucugccugaagaucacccaggaggggcggggccacgucaagcucucccgcgggagcgaggugguccuggacgccugcgacuccagcugcgaggugaugauccccaagggcacgggcgacauccugguggacugcuccgggggccagcagcacuuccugaaggacaaccucaucgaccuggggugcccgcacaucccccugcucggccggauggccaucuacaucugccgcaugagcaaccacccccggaccaccauggccuuccuguucugguucuccuucggcuacgucaucacgugcaucuucugcaaggcccuguucuacagccucaucaucaucgggacccugggcaagaagaucaagcaguaccgcgagcugaagccccagacgugcaccaucugcgagaccgcgccggugaacgccaucgacgccgagaugcacgaccucaacugcuccuacaacaucugccccuacugcgccagccggcugaccuccgacgggcuggcgcgccacgugacgcagugccccaagcggaaggagaaggucgaggagaccgagcucuaccugaaccuggagcgcaucccguggaucgugcggaagcuccuccaggugagcgagagcaccggcgucgcccugaagcgcuccagcuggcucaucgugcugcuggugcuccugaccgucucccugagccccgugcaguccgcccccguggggcacggcaagacgaucgagaucuaccagacccgggagggcuucgccagcaucugccucuucaugcugggguccauccuguucaucgucagcugccucgugaagggccugguggacuccgucagcgaguccuucuuccccgggcugagcgugugcaagaccugcuccaucggcagcgugaacggguucgagaucgagucccacaagugcuacugcagccucuucugcugcccguacugccgccacugcuccgccgaccgggagauccaccagcugcaccugagcaucugcaagaagcgcaagaccggcuccaacgucaugcucgcggugugcaagcggaugugcuuccgcgccacgaucgaggccagccgccgggcccugcugauccgcagcaucaucaacaccaccuucgugaucugcauccucacccugacgaucugcgucguguccaccagcgccguggagauggagaaccugcccgcgggcaccugggagcgggaggaggaccucaccaacuucugccaccaggagugccaggucacggagaccgagugccugugccccuacgaggcccuggugcuccgcaagccccuguuccuggacuccaucgugaaggggaugaagaaccuccugaacagcaccucccuggagaccagccucuccaucgaggccccguggggcgccaucaacguccagagcacguucaagcccaccguguccaccgccaacaucgcgcugagcugguccagcgugguccaccgggggaacaagauccuggugaccggccgcuccgagagcaucaugaagcucgaggagcggacggggguguccugggaccugggcgucgaggacgccagcgaguccaagcugcucaccgugagcaucauggaccugucccagauguacagccccguguucgaguaccugagcggcgaccgccaggucgaggaguggcccaaggcgaccugcaccggggacugcccggagcggugcggcugcacguccagcacgugccuccacaaggaguggucccacagccgcaacuggcggugcaaccccaccuggugcuggggcgugggcaccgggugcacgugcugcggcguggacgucaaggaccuguucaccgaccacauguucgugaaguggaagguggaguacaucaagaccgaggccaucgucugcguggcgcugaccucccaggagcgccagugcagccucaucgaggccggcacccgguucaaccuggggcccgugacgaucacccuguccgagccccgcaacauccagcagaagcucccgcccgagaucaucacccugcaccccaagaucgaggagggcuucuucgaccugaugcacguccagaaggugcucagcgccuccaccgugugcaagcugcagagcugcacgcacgggauccccggcgaccugcaggucuaccacaucggcaaccuccugaagggggaccgggugaacggccaccugauccacaagaucgagucccacuucaacaccagcuggauguccugggacgggugcgaccucgacuacuacugcaacaugggcgacuggccgagcugcaccuacaccggggucacgcagcacaaccacgccgccuucgugaaccugcugaacaucgagaccgacuacaccaagaccuuccacuuccacuccaagcgcgugacggcgcacggcgacaccccgcagcucgaccugaaggcccggcccaccuacggcgccgggggcaucaccguccugguggagguggccgacauggagcuccacacgaagaaggucgagaucagcgggcugaaguucgccucccuggcgugcaccggcugcuacgccugcagcuccgggaucagcugcaaggugcgcauccacguggacgagcccgacgagcucaccguccacgucaagagcuccgacccggacguggucgccgccagcaccucccugauggcccggaagcuggaguucggcacggacagcaccuucaaggcguucuccgccaugcccaagaccagccucugcuucuacaucguggagcgcgaguacugcaaguccugcagcgaggacgacacccagaagugcguggacacgcggcuggagcagccccaguccauccugaucgagcacaagggcaccaucaucgggaagcagaacgacacgugcaccgccaaggccagcugcuggcucgaguccgucaagagcuucuucuacggccugaagaacaugcugggguccguguucggcaaccucuucaucgggauccugcuguuccucgcgcccuucgugcugcugguccuguucuucauguucggcuggaagauccucuucugcuucaagugcugccgccgcacgcggggccuguucaaguaccgccaccugaaggacgacgaggagaccggguaccggcgcaucaucgagcggcucaacagcaagaagggcaagaaccgccugcuggacggggaccggcucgccgaccgcaagaucgccgagcuguucuccaccaagacccacaucggcuga

SEQ ID NO: 16895 - RNA, 3579 nt, Artificial Sequence
  derived and/or modified CDS sequence (opt1) from CCHVF(10200)__U39455.2__SP-GP_Gn-NSm-Gc
augcacaucagccugauguacgccauccucugccugcagcugugcggccucggggagacccacggcucccacaacgagaccagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcagggcaagaccaucgaggccuaccgggcccgcgagggguacaccuccaucugccucuucguccugggcagcauccuguucaucguguccugccucaugaaggggcugguggacagcgucggcaacuccuucuuccccggccugagcaucugcaagacgugcagcaucuccagcaucaacggguucgagaucgagucccacaagugcuacugcagccucuucugcugcccguacugccggcacugcuccaccgacaaggagauccacaagcugcaccugagcaucugcaagaagcgcaagaccggcuccaacgugaugcucgccgugugcaagcugaugugcuuccgcgcgaccauggaggucagcaaccgggcccuguucauccgcuccaucaucaacacgaccuucgugcucugcauccugauccuggccgugugcgucgugagcaccuccgccguggagauggagaaccuccccgccgggaccugggagcgggaggaggaccugacgaacuucugccaccaggagugccaggucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucggguga

SEQ ID NO: 16896 - RNA, 3552 nt, Artificial Sequence
  derived and/or modified CDS sequence (opt1) from CCHVF(10200)__U39455.2__IgE-leader_Gn-NSm-Gc
auggacuggaccuggauccuguuccucguggccgccgcgacccgcguccacagcagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcagggcaagaccaucgaggccuaccgggcccgcgagggguacaccuccaucugccucuucguccugggcagcauccuguucaucguguccugccucaugaaggggcugguggacagcgucggcaacuccuucuuccccggccugagcaucugcaagacgugcagcaucuccagcaucaacggguucgagaucgagucccacaagugcuacugcagccucuucugcugcccguacugccggcacugcuccaccgacaaggagauccacaagcugcaccugagcaucugcaagaagcgcaagaccggcuccaacgugaugcucgccgugugcaagcugaugugcuuccgcgcgaccauggaggucagcaaccgggcccuguucauccgcuccaucaucaacacgaccuucgugcucugcauccugauccuggccgugugcgucgugagcaccuccgccguggagauggagaaccuccccgccgggaccugggagcgggaggaggaccugacgaacuucugccaccaggagugccaggucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucggguga

SEQ ID NO: 16897 - RNA, 2973 nt, Artificial Sequence
  derived and/or modified CDS sequence (opt1) from CCHVF(10200)__U39455.2__IgE-leader_Gn-4aa-Gc
auggacuggaccuggauccuguuccucguggccgccgcgacccgcguccacagcagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucggguga

SEQ ID NO: 16898 - RNA, 1029 nt, Artificial Sequence
  derived and/or modified CDS sequence (opt1) from CCHVF(10200)__U39455.2__IgE-leader_Gn
auggacuggaccuggauccuguuccucguggccgccgcgacccgcguccacagcagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucggguga

SEQ ID NO: 16899 - RNA, 1989 nt, Artificial Sequence
  derived and/or modified CDS sequence (opt1) from CCHVF(10200)__U39455.2__IgE-leader_Gc
auggacuggaccuggauccuguuccucguggccgccgcgacccgcguccacagcuuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucggguga

SEQ ID NO: 16900 - RNA, 1449 nt, Artificial Sequence; identical to SEQ ID NO: 6642
  derived and/or modified CDS sequence (opt1) from CCHFV(10200)__NC_005302.1/U88410.1__N

SEQ ID NO: 16901 - RNA, 1449 nt, Artificial Sequence; identical to SEQ ID NO: 6643
  derived and/or modified CDS sequence (opt1) from CCHFV(Turkey-Kelkit06)__GQ337053.1__N

SEQ ID NO: 16902 - RNA, 5055 nt, Artificial Sequence; identical to SEQ ID NO: 11895
  derived and/or modified CDS sequence (opt1) from CCHFV(10200)__U39455.2__GP

SEQ ID NO: 16903 - RNA, 5055 nt, Artificial Sequence; identical to SEQ ID NO: 11896
  derived and/or modified CDS sequence (opt1) from CCHFV(IbAr10200)__AF467768.2__GP

SEQ ID NO: 16904 - RNA, 5067 nt, Artificial Sequence; identical to SEQ ID NO: 11897
  derived and/or modified CDS sequence (opt1) from CCHFV(Turkey-Kelkit06)__GQ337054.1__GP

SEQ ID NO: 16905 - RNA, 3579 nt, Artificial Sequence
  derived and/or modified CDS sequence (opt1) from CCHVF(10200)__U39455.2__SP-GP_Gn-NSm-Gc
augcacaucagccugauguacgccauccucugccugcagcugugcggccucggggagacccacggcucccacaacgagaccagcgaggagcccuccgacgacugcgugagccgcacgcagcugcugcggaccgagaccgccgagauccacggggacaacuacggcgggccgggcgacaagaucaccaucugcaacggcuccacgaucgucgaccagcgccucgggagcgagcugggcugcuacaccaucaaccgggugcgcuccuucaagcugugcgagaacagcgcgaccgggaagaacugcgagaucgacuccgugcccgucaagugccggcagggcuacugccuccgcaucacccaggaggggcggggccacgugaagcugagccgcggcuccgaggugguccuggacgccugcgacacgagcugcgagaucaugauccccaaggggaccggcgacauccucguggacugcuccgggggccagcagcacuuccugaaggacaaccugaucgaccucggcugccccaagaucccgcugcuggggaagauggccaucuacaucugccggaugagcaaccaccccaagaccaccauggccuuccucuucugguucuccuucggcuacgugaucacgugcauccugugcaaggccaucuucuaccugcucaucaucgucgggacccugggccgccggcugaagcaguaccgcgagcucaagccccagaccugcaccaucugcgagacgacccccgugaacgcgaucgacgccgagaugcacgaccugaacugcagcuacaacaucugcccguacugcgccucccggcugaccagcgacgggcucgcccgccacgugauccagugccccaagcggaaggagaaggucgaggagaccgagcuguaccugaaccucgagcgcauccccuggguggugcggaagcugcugcaggucuccgagagcacgggcguggcgcucaagcgcagcuccuggcugaucgugcugcucguccuguucaccgugagccugucccccgugcagagcgccccgaucggccaggggaagaccaucgaggccuaccgggcccgcgagggcuacaccuccaucugccucuucguccuggggagcauccuguucaucguguccugccucaugaagggccugguggacagcgucgggaacuccuucuuccccggccugagcaucugcaagacgugcuccaucagcuccaucaacggcuucgagaucgagagccacaagugcuacugcucccucuucugcugccccuacugccggcacugcagcaccgacaaggagauccacaagcugcaccuguccaucugcaagaagcgcaagaccgggagcaacgugaugcucgccgucugcaagcugaugugcuuccgcgcgaccauggagguguccaaccgggcccuguucauccgcagcaucaucaacacgaccuucgugcugugcauccucauccuggccgucugcguggugagcaccuccgccgucgagauggagaaccugcccgccggcaccugggagcgggaggaggaccucacgaacuucugccaccaggagugccaggugaccgagaccgagugccugugcccguacgaggcgcuggugcuccgcaagccccuguuccuggacagcaccgccaaggggaugaagaaccuccugaacuccacgagccuggagaccucccucagcaucgaggcccccuggggcgccaucaacguccaguccaccuacaagcccaccgugagcaccgccaacaucgcgcuguccuggagcuccguggagcaccgggggaacaagauccuggucagcggccgcuccgagagcaucaugaagcucgaggagcggacgggcaucuccugggaccuggggguggaggacgccagcgaguccaagcugcucaccgugagcgucauggaccugagccagauguacuccccgguguucgaguaccugagcggcgaccgccagguggaggaguggcccaaggccaccugcaccggggacugccccgagcggugcggcugcacguccagcaccugccuccacaaggaguggccccacucccgcaacuggcggugcaacccgaccuggugcuggggcgucgggaccggcugcacgugcugcgggcuggacgugaaggaccuguucaccgacuacauguucgugaaguggaaggucgaguacaucaagaccgaggccaucgugugcguggagcucaccagccaggagcgccagugcucccugaucgaggccggcacgcgguucaaccuggggcccgucaccaucacccucagcgagccccgcaacauccagcagaagcugcccccggagaucaucacccugcacccccggaucgaggagggcuucuucgaccucaugcacgugcagaaggugcuguccgcgagcacggucugcaagcugcaguccugcacccacggcgugcccggggaccuccagguguaccacaucggcaaccugcugaagggggacaaggucaacggccaccucauccacaagaucgagccgcacuucaacaccagcuggauguccugggacgggugcgaccuggacuacuacugcaacaugggcgacuggcccagcugcaccuacacgggcgugacccagcacaaccacgccuccuucgugaaccugcucaacaucgagaccgacuacaccaagaacuuccacuuccacagcaagcgcgucacggcccacggggacaccccccagcuggaccugaaggcccggcccaccuacggcgcgggggagaucaccgugcucguggaggucgccgacauggagcugcacacgaagaagaucgagaucuccggccugaaguucgccagccucgccugcaccgggugcuacgccugcuccagcagcaucuccugcaaggugcgcauccacguggacgagccggacgagcugaccguccacgugaagagcgacgaccccgacguggucgcggccuccagcucccugauggcccggaagcucgaguucggcaccgacagcacguucaaggccuucuccgccaugcccaagaccagccugugcuucuacaucguggagcgcgagcacugcaaguccugcagcgaggaggacaccaagaagugcgugaacaccaagcuggagcagccccaguccauccucaucgagcacaagggcacgaucaucgggaagcagaacagcaccugcaccgcgaaggccuccugcuggcuggagagcgucaaguccuucuucuacggccugaagaacaugcucagcgggaucuucggcaacguguucauggggaucuuccuguuccuggccccguucauccuccugauccuguucuucauguucggcuggcgcauccucuucugcuucaagugcugccggcgcacccggggccuguucaaguaccgccaccugaaggacgacgaggagaccggguaccggcgcaucaucgagaagcucaacaacaagaagggcaagaacaagcugcuggacggggagcggcucgccgacggccgcaucgccgagcuguucuccacgaagacccacaucggcuga

SEQ ID NO: 16906 - RNA, 3552 nt, Artificial Sequence
  derived and/or modified CDS sequence (opt1) from CCHVF(10200)__U39455.2__IgE-leader_Gn-NSm-Gc
auggacuggaccuggauccuguuccucguggccgccgcgacccgcguccacagcuccgaggagcccagcgacgacugcgugucccggacgcagcugcugcgcaccgagaccgccgagauccacggcgacaacuacgggggcccgggggacaagaucaccaucugcaacggcagcacgaucguggaccagcggcucggguccgagcugggcugcuacaccaucaaccgcguccggagcuucaagcugugcgagaacuccgccaccggcaagaacugcgagaucgacagcgugcccgugaagugccgccagggguacugccuccggaucacccaggagggccgcgggcacgucaagcugucccggggcagcgagguggugcuggacgccugcgacacguccugcgagaucaugauccccaaggggaccggcgacauccucgucgacugcagcggcgggcagcagcacuuccugaaggacaaccugaucgaccucggcugccccaagaucccgcugcuggggaagauggccaucuacaucugccgcauguccaaccaccccaagaccaccauggcguuccucuucugguucagcuucggcuacgugaucacgugcauccugugcaaggccaucuucuaccugcucaucaucgugggcacccuggggcggcgccugaagcaguaccgggagcucaagccccagaccugcaccaucugcgagacgacccccgucaacgccaucgacgccgagaugcacgaccugaacugcuccuacaacaucugcccguacugcgcgagccgccugaccuccgacggccucgcccggcacgugauccagugccccaagcgcaaggagaagguggaggagaccgagcuguaccugaaccucgagcggauccccugggucgugcgcaagcugcugcaggugagcgaguccacgggggucgcccucaagcggagcagcuggcugaucgugcugcucgugcuguucaccgucucccugagccccgugcaguccgccccgaucggccaggggaagaccaucgaggccuaccgcgcgcgggagggcuacaccagcaucugccucuucgugcugggcuccauccuguucaucgucagcugccucaugaaggggcugguggacuccgucggcaacagcuucuuccccgggcuguccaucugcaagacgugcagcaucuccagcaucaacggcuucgagaucgagucccacaagugcuacugcagccucuucugcugccccuacugccgccacugcuccaccgacaaggagauccacaagcugcaccugagcaucugcaagaagcgcaagaccggguccaacgugaugcucgccgugugcaagcugaugugcuuccgggccaccauggaggucagcaaccgcgcccuguucauccgguccaucaucaacacgaccuucgugcucugcauccugauccuggccgugugcgucgugagcaccagcgcgguggagauggagaaccugcccgccggcaccugggagcgcgaggaggaccucacgaacuucugccaccaggagugccaggucaccgagaccgagugccugugcccguacgaggcccuggugcuccggaagccccuguuccuggacuccaccgccaagggcaugaagaaccuccugaacagcacgucccuggagaccagccucuccaucgaggcccccuggggggcgaucaacgugcagagcaccuacaagcccaccgucuccaccgccaacaucgcccugagcugguccagcguggagcaccgcggcaacaagauccugguguccgggcggagcgaguccaucaugaagcucgaggagcgcacgggcaucagcugggaccugggggucgaggacgccuccgagagcaagcugcucaccguguccgugauggaccugagccagauguacagcccggucuucgaguaccuguccggcgaccggcagguggaggaguggcccaaggccaccugcaccggcgacugccccgagcgcugcgggugcacgagcuccaccugccuccacaaggaguggccccacagccggaacuggcgcugcaacccgaccuggugcuggggcguggggaccggcugcacgugcugcggccuggacgucaaggaccuguucaccgacuacauguucgugaaguggaagguggaguacaucaagaccgaggcgaucgucugcguggagcucaccucccaggagcggcagugcagccugaucgaggccgggacgcgcuucaaccugggccccgugaccaucacccucuccgagccccggaacauccagcagaagcugcccccggagaucaucacccugcacccccgcaucgaggagggguucuucgaccucaugcacguccagaaggugcugagcgccuccacggugugcaagcugcagagcugcacccacggcguccccggggaccuccagguguaccacaucggcaaccugcugaagggcgacaaggugaacgggcaccucauccacaagaucgagccgcacuucaacaccuccuggaugagcugggacggcugcgaccuggacuacuacugcaacaugggggacuggcccuccugcaccuacacgggcgucacccagcacaaccacgccagcuucgugaaccugcucaacaucgagaccgacuacaccaagaacuuccacuuccacuccaagcgggugacggcgcacggggacaccccccagcuggaccugaaggcccgccccaccuacggcgccggcgagaucaccguccucguggagguggccgacauggagcugcacacgaagaagaucgagaucagcgggcugaaguucgccucccucgcgugcaccggcugcuacgccugcagcuccagcaucagcugcaagguccggauccacguggacgagccggacgagcugaccgugcacgucaaguccgacgaccccgacgugguggccgccagcuccagccugauggcccgcaagcucgaguucgggaccgacuccacguucaaggcguucagcgccaugcccaagaccucccugugcuucuacaucgucgagcgcgagcacugcaagagcugcuccgaggaggacaccaagaagugcgugaacaccaagcuggagcagccccagagcauccucaucgagcacaagggcacgaucaucgggaagcagaacuccaccugcaccgccaaggccagcugcuggcuggaguccgugaagagcuucuucuacggccugaagaacaugcucuccggcaucuucgggaacgucuucaugggcaucuuccuguuccuggccccguucauccuccugauccuguucuucauguucggguggcggauccucuucugcuucaagugcugccgccggacccgcggccuguucaaguaccggcaccugaaggacgacgaggagaccggguaccgccggaucaucgagaagcucaacaacaagaagggcaagaacaagcugcuggacggcgagcgccucgcggacgggcggaucgccgagcuguucagcacgaagacccacaucggcuga

SEQ ID NO: 16907 - RNA, 2973 nt, Artificial Sequence
  derived and/or modified CDS sequence (opt1) from CCHVF(10200)__U39455.2__IgE-leader_Gn-4aa-Gc
auggacuggaccuggauccuguuccucguggccgccgcgacccgcguccacagcuccgaggagcccagcgacgacugcgugucccggacgcagcugcugcgcaccgagaccgccgagauccacggcgacaacuacgggggcccgggggacaagaucaccaucugcaacggcagcacgaucguggaccagcggcucggguccgagcugggcugcuacaccaucaaccgcguccggagcuucaagcugugcgagaacuccgccaccggcaagaacugcgagaucgacagcgugcccgugaagugccgccagggguacugccuccggaucacccaggagggccgcgggcacgucaagcugucccggggcagcgagguggugcuggacgccugcgacacguccugcgagaucaugauccccaaggggaccggcgacauccucgucgacugcagcggcgggcagcagcacuuccugaaggacaaccugaucgaccucggcugccccaagaucccgcugcuggggaagauggccaucuacaucugccgcauguccaaccaccccaagaccaccauggcguuccucuucugguucagcuucggcuacgugaucacgugcauccugugcaaggccaucuucuaccugcucaucaucgugggcacccuggggcggcgccugaagcaguaccgggagcucaagccccagaccugcaccaucugcgagacgacccccgucaacgccaucgacgccgagaugcacgaccugaacugcuccuacaacaucugcccguacugcgcgagccgccugaccuccgacggccucgcccggcacgugauccagugccccaagcgcaaggagaagguggaggagaccgagcuguaccugaaccucgagcggauccccugggucgugcgcaagcugcugcaggugagcgaguccacgggggucgcccucaagcggagcagcuggcugaucgugcugcucgugcuguucaccgucucccugagccccgugcaguccgccccgaucggccgcaagccccucuuccuggacagcaccgccaaggggaugaagaaccugcucaacuccaccagccuggagacgucccugagcaucgaggcgcccuggggcgccaucaacgugcaguccaccuacaagcccaccgucagcaccgccaacaucgcccucuccuggagcuccguggagcaccggggcaacaagauccuggucagcgggcgcuccgagagcaucaugaagcuggaggagcgcacgggcaucuccugggaccucgggguggaggacgccagcgaguccaagcugcugaccgugagcgucauggaccucagccagauguacuccccgguguucgaguaccugagcggcgaccggcagguggaggaguggcccaaggcgaccugcaccggggacugccccgagcgcugcggcugcacguccagcaccugccugcacaaggaguggccccacucccggaacuggcgcugcaacccgaccuggugcuggggcgucgggaccggcugcacgugcugcgggcuggacgugaaggaccucuucaccgacuacauguucgugaaguggaaggucgaguacaucaagaccgaggccaucgugugcguggagcugaccagccaggagcggcagugcucccugaucgaggccggcacccgcuucaaccucgggcccgucacgaucacccugagcgagccccggaacauccagcagaagcugcccccggagaucaucacccuccacccccgcaucgaggagggcuucuucgaccugaugcacgugcagaaggugcuguccgccagcaccgucugcaagcuccaguccugcacgcacggcgugcccggggaccugcagguguaccacaucggcaaccugcucaagggggacaaggucaacggccaccugauccacaagaucgagccccacuucaacaccagcuggauguccugggacggcugcgaccuggacuacuacugcaacaugggggacuggccgagcugcaccuacaccggcgugacgcagcacaaccacgccuccuucgugaaccuccugaacaucgagaccgacuacaccaagaacuuccacuuccacagcaagcgggucaccgcgcacggggacacgccccagcuggaccucaaggcccgccccaccuacggcgccggggagaucaccgugcugguggaggucgccgacauggagcugcacaccaagaagaucgagaucuccggccucaaguucgccagccuggcgugcacgggcugcuacgccugcagcuccagcaucuccugcaaggugcggauccacguggacgagccggacgagcugaccguccacgugaagagcgacgaccccgacguggucgccgccuccagcucccucauggcgcgcaagcuggaguucgggaccgacagcaccuucaaggccuucuccgccaugcccaagacgagccugugcuucuacaucguggagcgggagcacugcaaguccugcagcgaggaggacaccaagaagugcgugaacaccaagcucgagcagccccaguccauccugaucgagcacaagggcaccaucaucgggaagcagaacagcacgugcaccgccaaggccuccugcuggcuggagagcgucaaguccuucuucuacggccucaagaacaugcugagcgggaucuucggcaacguguucaugggcaucuuccuguuccucgcgccguucauccugcugauccucuucuucauguucggguggcgcauccuguucugcuucaagugcugccggcgcacccggggccuguucaaguaccgccaccucaaggacgacgaggagaccggguaccggcgcaucaucgagaagcugaacaacaagaagggcaagaacaagcugcucgacggggagcgccuggccgacggccggaucgccgagcuguucuccacgaagacccacaucggcuga

SEQ ID NO: 16908 - RNA, 1029 nt, Artificial Sequence
  derived and/or modified CDS sequence (opt1) from CCHVF(10200)__U39455.2__IgE-leader_Gn
auggacuggaccuggauccuguuccucguggccgccgcgacccgcguccacagcuccgaggagcccagcgacgacugcgugucccggacgcagcugcugcgcaccgagaccgccgagauccacggcgacaacuacgggggcccgggggacaagaucaccaucugcaacggcagcacgaucguggaccagcggcucggguccgagcugggcugcuacaccaucaaccgcguccggagcuucaagcugugcgagaacuccgccaccggcaagaacugcgagaucgacagcgugcccgugaagugccgccagggguacugccuccggaucacccaggagggccgcgggcacgucaagcugucccggggcagcgagguggugcuggacgccugcgacacguccugcgagaucaugauccccaaggggaccggcgacauccucgucgacugcagcggcgggcagcagcacuuccugaaggacaaccugaucgaccucggcugccccaagaucccgcugcuggggaagauggccaucuacaucugccgcauguccaaccaccccaagaccaccauggcguuccucuucugguucagcuucggcuacgugaucacgugcauccugugcaaggccaucuucuaccugcucaucaucgugggcacccuggggcggcgccugaagcaguaccgggagcucaagccccagaccugcaccaucugcgagacgacccccgucaacgccaucgacgccgagaugcacgaccugaacugcuccuacaacaucugcccguacugcgcgagccgccugaccuccgacggccucgcccggcacgugauccagugccccaagcgcaaggagaagguggaggagaccgagcuguaccugaaccucgagcggauccccugggucgugcgcaagcugcuccaggugagcgaguccacgggggucgcccugaagcggagcagcuggcugaucgugcugcucgugcuguucaccgucucccugagccccgugcaguccgccccgaucggcuga

SEQ ID NO: 16909 - RNA, 1989 nt, Artificial Sequence
  derived and/or modified CDS sequence (opt1) from CCHVF(10200)__U39455.2__IgE-leader_Gc
auggacuggaccuggauccuguuccucguggccgccgcgacccgcguccacagcuuccuggacuccacggccaagggcaugaagaaccugcucaacagcaccucccuggagaccagccuguccaucgaggcccccuggggcgccaucaacgugcagagcaccuacaagccgacgguguccaccgccaacaucgcgcucagcugguccagcgucgagcaccgggggaacaagauccugguguccgggcgcagcgaguccaucaugaagcuggaggagcggaccggcaucagcugggaccucgggguggaggacgccuccgagagcaagcugcugaccgucuccgugauggaccucagccagauguacucccccguguucgaguaccugagcggcgaccgccaggucgaggaguggcccaaggccacgugcaccggcgacugccccgagcggugcgggugcaccagcuccacgugccugcacaaggaguggccgcacagccgcaacuggcggugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaccucccaggagcgccagugcagccucaucgaggcgggcacccgguucaaccugggccccgugaccaucacgcuguccgagccccgcaacauccagcagaagcucccgcccgagaucaucacccugcacccccggaucgaggagggguucuucgaccugaugcacgugcagaagguccucagcgccuccaccgugugcaagcugcagagcugcacccacggcgugcccggggaccugcaggucuaccacaucggcaaccuccugaagggcgacaaggugaacgggcaccugauccacaagaucgagccgcacuucaacacguccuggaugagcugggacggcugcgaccucgacuacuacugcaacaugggggacuggcccuccugcaccuacaccggcgugacccagcacaaccacgccagcuucgucaaccugcugaacaucgagacggacuacaccaagaacuuccacuuccacuccaagcgcgugaccgcccacggggacacgccccagcucgaccugaaggcccggcccaccuacggcgcgggcgagaucaccguccugguggagguggccgacauggagcuccacaccaagaagaucgagaucagcgggcugaaguucgccucccuggccugcaccggcugcuacgccugcagcuccagcaucuccugcaagguccgcauccacguggacgagccggacgagcucacggugcacgucaagagcgacgaccccgacgugguggcggccagcuccagccugauggcccggaagcuggaguucgggaccgacuccaccuucaaggccuucagcgccaugcccaagaccucccucugcuucuacaucgucgagcgcgagcacugcaagagcugcuccgaggaggacaccaagaagugcgugaacacgaagcuggagcagccccagagcauccugaucgagcacaagggcaccaucaucgggaagcagaacuccacgugcaccgcgaaggccagcugcuggcucgaguccgucaagagcuucuucuacggccugaagaacaugcuguccggcaucuucgggaacguguucaugggcaucuuccucuuccuggccccguucauccugcugauccucuucuucauguucggguggcggauccuguucugcuucaagugcugccgccggacccgcggccuguucaaguaccggcaccucaaggacgacgaggagaccggguaccgccgcaucaucgagaagcugaacaacaagaagggcaagaacaagcugcucgacggcgagcggcuggccgacgggcgcaucgccgagcuguucagcaccaagacccacaucggcuga

SEQ ID NO: 16910 - RNA, 1449 nt, Artificial Sequence; identical to SEQ ID NO: 7334
  derived and/or modified CDS sequence (opt5) from CCHFV(10200)__NC_005302.1/U88410.1__N

SEQ ID NO: 16911 - RNA, 1449 nt, Artificial Sequence; identical to SEQ ID NO: 7335
  derived and/or modified CDS sequence (opt5) from CCHFV(Turkey-Kelkit06)__GQ337053.1__N

SEQ ID NO: 16912 - RNA, 5055 nt, Artificial Sequence; identical to SEQ ID NO: 13538
  derived and/or modified CDS sequence (opt5) from CCHFV(10200)__U39455.2__GP

SEQ ID NO: 16913 - RNA, 5055 nt, Artificial Sequence; identical to SEQ ID NO: 13539
  derived and/or modified CDS sequence (opt5) from CCHFV(IbAr10200)__AF467768.2__GP

SEQ ID NO: 16914 - RNA, 5067 nt, Artificial Sequence; identical to SEQ ID NO: 13540
  derived and/or modified CDS sequence (opt5) from CCHFV(Turkey-Kelkit06)__GQ337054.1__GP

SEQ ID NO: 16915 - RNA, 3579 nt, Artificial Sequence
  derived and/or modified CDS sequence (opt5) from CCHVF(10200)__U39455.2__SP-GP_Gn-NSm-Gc
augcacaucagccugauguacgccauucucugccugcagcuuuguggccugggggagacccauggaucccacaacgaaacaucugaggaacccagcgacgauugcguguccagaacgcagcuccugcggaccgagacagcugaaauccauggcgacaauuaugggggaccuggcgauaagauuaccaucuguaacgggucuacaauugucgaccagcgccuuggaagcgagcugggcugcuacaccaucaauagaguucgguccuucaaacucugugagaacucugccacaggcaagaauugcgaaaucgauagcgugccggugaaaugucgccagggguauugccugagaauuacccaggagggacggggccacgucaagcugucccgcgggagcgaagugguucucgacgcgugugauacgucuugcgagaucaugauucccaaaggaaccggcgacauccugguggauuguuccgggggacaacagcauuuucuuaaggacaaccugauugaucucggcugcccuaagaucccccugcuuggcaaaauggcuauuuacaucugcagaaugagcaaucacccuaagacaaccauggccuuccuguuuugguucucuuuuggguaugucaucacauguauucucugcaaagccaucuucuaccugcugauuaucgugggaacccucggccggcgccugaagcaguauagagagcuuaaaccccagacguguacaauuugcgaaaccacaccuguuaacgcuaucgacgccgagaugcacgaucugaauuguuccuacaacaucugcccguacugugcuagccggcucaccucugacgggcuggcccgccaugugauucaaugccccaagagaaaggaaaaagucgaggaaaccgagcuuuaucugaaucucgagcggaucccuuggguggugcgcaagcugcugcaggucuccgaaagcacaggaguugcgcucaaaagauccucuuggcugauugugcuucuggugcucuuuacggucagccugucccccgugcagagcgccccuaucggccaggggaagaccauugaggcuuaccgggccagagaaggauauacaucuaucugucuuuucguucugggcuccauccucuuuauugugagcugccugaugaaaggccuggucgacucuguggggaacagcuucuuucccggacucuccaucuguaagaccugcucuauuagcuccaucaauggcuucgagauugaaagccacaaaugcuacuguucucuguuuugcuguccguauugccgccauuguuccacagauaaggagauccacaagcuccaccugagcauuugcaaaaagcggaaaaccgggucuaacguuaugcucgcuguguguaagcugaugugcuucagagccacgauggaggucuccaaucgcgcgcuguucauccggagcaucauuaacacaaccuuugugcuuuguauccucauucuggccgucugcgugguuuccaccucugcuguggaaauggagaaccugccugccggaacaugggaaagagaggaagaccucaccaauuucugucaucaagagugccaggucacagagacggaaugccugugucccuacgaggcucuugugcugcgcaaaccucucuuucuggauagcaccgccaagggcaugaagaaccugcuuaauuccacaucucucgaaaccagccuguccaucgaggcccccuggggcgcuauuaacguucagagcacauauaaacccaccgugucuacggcgaauaucgcccuguccuggagcucugucgagcaccgggggaacaagauccucguguccggaagaagcgaaucuauuaugaaacuggaggaacgcaccggcaucagcugggaccuugggguggaggaugcuuccgaaagcaagcugcucacaguuucugucauggaccugucccaaauguacagcccuguguucgaguaccuguccggagauagacagguggaggaauggccgaaagcuaccugcacaggcgacugucccgagcggugcggguguaccucuagcacgugccuucauaaggaauggccucacucccgcaauuggcgguguaaccccacauggugcuggggagucggcaccggguguacaugcuguggccucgaugugaaggaccuguuuaccgauuauauguucguuaaauggaagguggaguacauuaaaaccgaagccaucgucugcguggagcugacaucucaggagagacagugcagccucauugaagccggaacgcgguuuaaucugggcccuguuaccaucacacuuuccgagccccgcaacauccaacagaagcugccgccugaaauuaucacccuccaucccagaauugaggaaggguucuuugaccugaugcacgugcagaaaguccugucugccagcacaguguguaaacuucaguccugcacccacggaguuccuggcgaccuccaaguguaucauaucgggaaucugcugaagggagauaaagucaacggccaccucauucauaagaucgagccccacuucaauacgagcuggaugucuugggacgggugugaucuggacuacuauugcaacaugggcgauuggccuuccuguacauacaccggagugacccagcacaaucaugcgagcuuugugaaccuucugaacaucgagacagacuauaccaaaaauuuccacuuucauucuaagcgggucacagcucacggcgauacgccccagcucgaccugaaagccagaccgaccuacggggccggagaaauuacaguucugguggagguggcugauauggaacuucauaccaagaaaaucgagauuuccggccugaaguucgccagccucgcuugcacaggguguuacgccuguucuuccagcaucuccugcaagguccgcauucacguggacgagccugaugaacugaccguucacgugaaaagcgacgaucccgacgucguggcggccucuagcucccucauggcucggaagcuggaguucggaacggacucuaccuuuaaagccuucagcgcuaugcccaagacaucccuuugcuuuuauaucguugaaagagagcauuguaaaucuugcagcgaagaggauaccaagaagugcgugaacacaaaacuggagcagccucaauccauucucaucgaacacaagggcaccaucauugggaaacaaaauucuacauguaccgccaaggcgagcugcuggcuggaguccgucaagagcuucuuuuacggccugaagaacaugcuuucuggaaucuucggcaauguguuuauggggauuuuccuguuucucgccccguucauccugcucauucuguuuuucauguuuggauggcgcauccuuuucuguuucaagugcuguagacggacgcgcggccuguuuaaauauagacaucucaaggacgaugaagagacaggguaccggcgcaucauugaaaaacugaacaauaagaaaggaaagaacaagcugcuugacggcgagagacuggcugauggccggaucgccgagcuuuucuccaccaaaacccacauuggguga

SEQ ID NO: 16916 - RNA, 3552 nt, Artificial Sequence
  derived and/or modified CDS sequence (opt5) from CCHVF(10200)__U39455.2__IgE-leader_Gn-NSm-Gc
auggacuggaccuggauccuguuccucguggccgcugccacaagaguccacagcuccgaggaacccucugaugacugcguuagccggacgcagcugcuucgcaccgagacagcggaaauucauggcgauaacuacgggggaccuggcgacaagaucaccauuuguaauggguccacaaucguggaucaaagacugggaucugagcucggcugcuauaccauuaaccgggugcgcagcuuuaaacugugugaaaauuccgcuacagggaagaacugcgagaucgacucugucccggugaaauguagacagggauacugccuucggaucacccaggagggccgcggccacguuaagcugagcagaggguccgaagugguccucgaugccugugacacgagcugcgagauuaugauccccaaaggaaccggcgauauucugguggacuguucugggggacagcaacauuuccugaaggauaaucucaucgaccugggcugcccuaagauuccccuucuggggaaaauggccaucuauauuugucggauguccaaccacccuaagacaaccauggcuuuucucuucugguuuagcuucggauacguuaucacaugcauccugugcaaagccaucuuuuaucuucugauuauugugggcacccucggccgcagacugaagcaguaccgggaacugaaaccccagacguguacaaucugcgagaccacaccugucaaugcuauugaugccgagaugcaugaccucaacuguucuuauaauaucugcccguacugugcgucccgccugaccagcgacgggcuugccagacacgugauccagugccccaagcggaaggaaaaaguggaggaaaccgagcuguaccucaaccuggaacgcauuccuugggucguuagaaagcugcugcaagugucugaguccacaggaguggcucucaaacggagcuccuggcugaucguccugcucgugcuguucacgguuucucuuagccccgugcaguccgccccuauuggccaggggaagaccaucgaggcuuauagagcccgcgaaggauacacaagcauuugucuguuuguccucggcucuauccuguucaucguguccugccuuaugaaagggcugguugauagcgugggaaauucuuucuuucccggccucagcauuuguaagaccugcuccaucucuagcauuaacggcuuugagaucgaaucccacaaauguuauugcagccuguucugcuguccguacugccggcauuguucuacagacaaggagauucacaagcugcaucucuccaucugcaaaaagagaaaaaccgggagcaaugucaugcuggcgguguguaaacuuaugugcuuccgcgccacgauggaagucucuaaccgggcucuguuuauuagauccaucaucaauacaaccuucgugcucuguauucugauccuggccguuugcguggucagcaccuccgcuguggagauggagaaccuuccugccggaacaugggaacgcgaggaagaucucaccaacuuuugucaccaggagugccaaguuacagaaacggagugucugugccccuaugaggcccuggugcuccggaagccucuguuccuugacucuaccgcuaagggcaugaagaaucugcucaacagcacaucccuggaaaccucucugagcauugaggcgcccuggggagccaucaauguccaguccacauacaaacccaccgugagcacggcuaacauugcccuuucuugguccagcguggaacacagagggaauaagauccucguuucuggccgcuccgagagcaucaugaaacuggaggaacggaccgggauuucuugggaucugggcgucgaggacgccagcgaauccaagcuccugacagugagcgugauggaucuuucucagauguauuccccugucuuugaguaccugagcggagacagacaaguggaagaguggccgaaagcuaccugcacaggcgauugucccgagcgcugcggguguaccuccucuacgugccuccauaaggaauggccucacagccggaacuggagauguaaucccacauggugcuggggaguuggcaccggguguacaugcuguggacuggacgugaaggaucuguucaccgacuacauguuugucaaauggaagguggaguauaucaaaaccgaagccauuguuugcguggagcuuacaucccaggaacggcaguguucucucaucgaggcgggcacgcgcuucaaccuggggccugucaccauuacacugagcgagcccagaaauauccagcaaaagcucccgccugaaaucauuacccugcauccccggaucgaggaaggcuuuuucgaccuuaugcacgugcagaaaguucuguccgcuucuacagugugcaagcuccagagcugcacccauggagucccuggcgaucuucagguguaccacauugggaaccugcuuaagggagacaaagugaauggccaccucauccauaagauugagccccacuuuaacacguccuggaugagcugggaugggugugaccuggauuauuacugcaauaugggagacuggccuucuuguacauauaccggcgucacccaacauaaccacgccuccuucguuaaucugcucaacaucgaaacagauuacaccaaaaacuuucacuuccauagcaagagagugacagcccacggggacacgccccagcuggaucuuaaagcucgcccgaccuauggcgccggagagaucacagugcuggucgagguggcugacauggaacuccauaccaagaaaauugagaucucuggccugaaguucgccucccuggcgugcacaggguguuacgccugcucuagcuccauuagcuguaagguucggauccacguggaugaaccugacgagcuuaccguccaugugaaauccgaugaccccgacguuguggcugccagcucuagccugauggcuagaaagcucgaguuuggaacggauuccaccuucaaagccuuuucugcgaugcccaagacaagccugugcuucuacauugucgaacgcgagcacuguaaauccugcucugaagaggacaccaagaagugugugaauacaaaacucgaacagccucagagcauccugauugagcacaagggcaccaucaucgggaaacaaaacuccacaugcaccgccaaggcuucuugcuggcuugagagcguuaaauccuuuuucuauggacugaagaauaugcucagcggcauuuuugggaacguguucaugggcaucuuucuguuccuggccccguuuauucuucugauccucuucuuuauguucggauggcggauucuguucuguuuuaagugcuguagacgcacgagaggccucuucaaauaccggcaucugaaggaugacgaagagacaggguaucgcagaaucaucgaaaaacuuaauaacaagaaaggaaagaauaagcugcucgauggcgagcggcuggcugacgggcgcauugccgaacuguuuucuaccaaaacccacaucggauga

SEQ ID NO: 16917 - RNA, 2973 nt, Artificial Sequence
  derived and/or modified CDS sequence (opt5) from CCHVF(10200)__U39455.2__IgE-leader_Gn-4aa-Gc
auggacuggaccuggauccuguuccucguggccgcugccacaagaguccacagcuccgaggaacccucugaugacugcguuagccggacgcagcugcuucgcaccgagacagcggaaauucauggcgauaacuacgggggaccuggcgacaagaucaccauuuguaauggguccacaaucguggaucaaagacugggaucugagcucggcugcuauaccauuaaccgggugcgcagcuuuaaacugugugaaaauuccgcuacagggaagaacugcgagaucgacucugucccggugaaauguagacagggauacugccuucggaucacccaggagggccgcggccacguuaagcugagcagaggguccgaagugguccucgaugccugugacacgagcugcgagauuaugauccccaaaggaaccggcgauauucugguggacuguucugggggacagcaacauuuccugaaggauaaucucaucgaccugggcugcccuaagauuccccuucuggggaaaauggccaucuauauuugucggauguccaaccacccuaagacaaccauggcuuuucucuucugguuuagcuucggauacguuaucacaugcauccugugcaaagccaucuuuuaucuucugauuauugugggcacccucggccgcagacugaagcaguaccgggaacugaaaccccagacguguacaaucugcgagaccacaccugucaaugcuauugaugccgagaugcaugaccucaacuguucuuauaauaucugcccguacugugcgucccgccugaccagcgacgggcuugccagacacgugauccagugccccaagcggaaggaaaaaguggaggaaaccgagcuguaccucaaccuggaacgcauuccuugggucguuagaaaacuucugcaagugucugaguccacaggaguggcucucaagcggagcuccuggcugaucguccugcucgugcuguucacgguuucucuuagccccgugcaguccgccccuauuggcagaaagccccuguuucucgauagcaccgcuaaagggaugaagaaucugcuuaacucuacaucccuggagaccagccucucuaucgaagccccguggggagcgauuaauguccagagcacauauaaaccuaccguguccacggccaacaucgcucugucuuggagcuccguugagcaccgcggcaauaagauccuggugagcgggcggucugaauccauuaugaagcucgaggaaagaacaggaaucagcugggaccugggcgucgaggaugccucugaguccaaacuucugaccgugagcgucauggaccucucccagauguacucucccguguucgaauaucugagcggcgaucgccaaguugaggaauggccuaaggcuaccuguacaggggacugccccgagcgguguggaugcaccuccucuacaugucugcauaaagaauggccccacagcagaaacuggcgcugcaacccuacguggugcuggggcguggggaccggauguacaugcuguggccuugaugucaaggaccucuuuaccgauuacauguucgugaaauggaagguugaguauauuaagacagaggccaucgugugcgucgaacugaccucccaggagcggcaguguagccugauugaagccgggacgagauuuaaucucggcccggugaccaucacacugucugagccccgcaacauucaacagaaacuuccucccgagaucaucacccugcauccucggauugaagagggauucuucgaccucaugcacgugcagaagguucuguccgcuagcacagucugcaaacugcagucuuguacccacggcgugcccggggaucuucaaguguaccauaucggaaaucuccugaagggcgacaaagucaacgggcaccugauucauaagaucgaaccgcacuuuaauacguccuggaugagcugggacggaugcgaucucgacuauuacuguaacaugggcgauuggccuucuugcacauacaccggggugacacagcauaaucacgcgagcuucguuaaccugcuuaauauugagaccgacuauaccaagaacuuucacuuccauuccaaaagagugacagcccacggcgauacgccccagcuggaccucaaggcucgcccuaccuacggagccggcgaaaucacaguccugguggagguugccgauauggagcugcauaccaaaaagaucgaaauuagcgggcuuaaauuugcuucucucgccuguacaggaugcuaugcgugcuccagcuccaucucuuguaaggugcggauucacgucgacgagcccgaugaacugaccgugcacguuaagagcgacgauccugacguggucgcugccuccucuagccugauggccagaaaacucgaguucggcacggauuccacauuuaaggcuuucucugccaugcccaaaaccagccugugcuuuuacaucguggaacgggagcauuguaaguccugcagcgaggaagacaccaaaaagugugugaauacaaaacuugagcagccgcaaucuauucugaucgaacacaaggggaccaucauuggaaagcagaacuccacaugcacggcuaaagccagcuguuggcucgagucugucaaguccuucuuuuauggccugaaaaauaugcugagcgggaucuucggcaacguuuuuaugggaauuuuccuuuuccucgcgccuuuuauccugcugauucucuucuuuauguucggcuggcgcauccuguuuugcuucaaguguugcagacggaccagagggcuuuuuaaauaccgccaucugaaggacgaugaagagacaggauaucggagaaucauugagaagcucaauaacaaaaagggcaaaaacaagcugcuggacggggaacgccuugccgauggaagaaucgcugagcuguucucuaccaaaacacacauuggcuga

SEQ ID NO: 16918 - RNA, 1029 nt, Artificial Sequence
  derived and/or modified CDS sequence (opt5) from CCHVF(10200)__U39455.2__IgE-leader_Gn
auggacuggaccuggauccuguuccucguggccgcugccacaagaguccacagcuccgaggaacccucugaugacugcguuagccggacgcagcugcuucgcaccgagacagcggaaauucauggcgauaacuacgggggaccuggcgacaagaucaccauuuguaauggguccacaaucguggaucaaagacugggaucugagcucggcugcuauaccauuaaccgggugcgcagcuuuaaacugugugaaaauuccgcuacagggaagaacugcgagaucgacucugucccggugaaauguagacagggauacugccuucggaucacccaggagggccgcggccacguuaagcugagcagaggguccgaagugguccucgaugccugugacacgagcugcgagauuaugauccccaaaggaaccggcgauauucugguggacuguucugggggacagcaacauuuccugaaggauaaucucaucgaccugggcugcccuaagauuccccuucuggggaaaauggccaucuauauuugucggauguccaaccacccuaagacaaccauggcuuuucucuucugguuuagcuucggauacguuaucacaugcauccugugcaaagccaucuuuuaucuucugauuauugugggcacccucggccgcagacugaagcaguaccgggaacugaaaccccagacguguacaaucugcgagaccacaccugucaaugcuauugaugccgagaugcaugaccucaacuguucuuauaauaucugcccguacugugcgucccgccugaccagcgacgggcuugccagacacgugauccagugccccaagcggaaggaaaaaguggaggaaaccgagcuguaccucaaccuggaacgcauuccuugggucguuagaaaacuucugcaagugucugaguccacaggaguggcucucaagcggagcuccuggcugaucguccugcucgugcuguucacgguuucucuuagccccgugcaguccgccccuauuggcuga

SEQ ID NO: 16919 - RNA, 1989 nt, Artificial Sequence
  derived and/or modified CDS sequence (opt5) from CCHVF(10200)__U39455.2__IgE-leader_Gc
auggacuggaccuggauccuguuccucguggccgcugccacaagaguccacagcuuucuggauuccacggcgaagggcaugaaaaaccuucucaauucuaccagccuggagacaucccugucuauugaagcucccuggggagccaucaacguucagagcaccuacaagccuacaguguccaccgccaauauugcucuuucuuggagcuccguggagcaucgggggaacaaaauccuggucagcggccgcucugaauccauuaugaagcucgaggaaagaacagggaucagcugggaccugggaguggaggaugccucugaguccaaacugcucaccguuagcgugauggaccugucucaaauguauuccccggucuucgaauaccuuagcggcgaucgccagguggaggaauggcccaaggcuacgugcaccggggacuguccugagcggugcggauguacauccucuaccugccugcacaaggaguggccccauagcagaaauuggcgguguaacccuacauggugcuggggcguuggcaccggguguacgugcuguggacucgaugugaaagaccuguuuacagauuauauguucgucaaguggaaaguggaauacaucaagaccgaggccauugugugcgucgaacuuacaucccaggagcgccaguguagccugaucgaagcgggcaccagauuuaaucucgggcccguuaccauuacacugucugagccucggaacauccaacagaaacugccgcccgagauuaucacgcuccacccucgcauugaagagggauucuuugaccugaugcaugugcagaaggugcuuuccgccagcaccgucugcaagcugcagucuugcacacacggcgugcccggggaucuccaaguuuaucacaucggaaaucugcuuaaaggcgacaaggugaacggccaucugauccacaaaauugaaccucauuucaauaccagcuggauguccugggaugggugugaccucgacuacuauugcaacaugggagauuggcccucuuguacauacaccggcgucacgcagcacaaucacgcuagcuuugugaaccugcugaauaucgagacagacuacaccaagaacuuccauuuucacuccaaaagaguuaccgcccauggggauacaccgcagcucgaccugaaggcucggccuaccuauggagccggcgaaauuacagugcuugucgagguggcggauauggagcugcacacgaaaaagaucgaaauuagcgggcucaaguucgccucucuggcuugcaccggauguuacgccugcuccagcucuaucuccuguaaaguccgcauccauguggacgagcccgaugaacuuacaguucacgugaaguccgacgauccugacgucguggcugccuccucuagccugauggccagaaaacucgaguuuggcaccgauuccacauucaaggcuuucucugcgaugcccaaaaccagccugugcuuuuauauuguugaacgggagcacuguaaguccugcagcgaggaagacacgaagaaaugugugaacaccaagcuggagcagccccaaucuauccucauugaacauaaaggcacaaucauugggaagcagaauagcacaugcaccgccaaagcuagcugcuggcuggagucugucaaguccuucuuuuacggacuuaagaacaugcugagcggcaucuucgggaauguguuuaugggaaucuuccucuuucuggccccuuucauucugcuuauccucuuuuucauguuuggcuggcgcauucuguucuguuuuaaaugcuguagacggaccagagggcuguucaaguaucgccaccucaaagacgaugaggaaacgggcuaccggagaaucauugagaagcugaacaauaaaaagggaaagaacaaacuucuggacggcgaacgccucgccgaugggcggaucgcugagcuguucucuacaaagacccauauuggauga

SEQ ID NO: 16920 - RNA, 1449 nt, Artificial Sequence
  derived and/or modified CDS sequence (opt11) from CCHFV(10200)__NC_005302.1/U88410.1__N
auggaaaacaaaaucgaggugaacaacaaagacgaaaugaaccgaugguucgaagaguucaagaaaggcaacggacuuguagacacguucaccaacuccuacuccuucugcgaaucaguccccaaccuagaccgauucgucuuccaaauggccagcgcaacagacgacgcacaaaaagacucgauauacgcauccgcccuaguagaagcaaccaaauucugcgcccccaucuacgaaugcgcuuggguaucuagcacaggaaucgucaagaaaggacucgaaugguucgagaaaaacgccggcacaaucaaauccugggacgaaucauacaccgaacuaaaaguagacguacccaaaauagaacaacucaccggcuaccaacaagccgcacuaaaauggcggaaagacaucggcuuccgcgucaacgccaacaccgccgcccucuccaacaaaguccuagccgaauacaaaguccccggcgaaaucgucauguccgucaaagaaaugcucuccgacaugaucagacggcgcaaccucauccuuaaccgcgggggagacgaaaauccccgcggacccgucucucacgaacacgucgacuggugccgcgaguucgucaaaggcaaauacauaauggcguucaacccacccuggggagacauaaacaaaucaggccggucaggcaucgcccucgucgccaccggacuagccaaacucgcagaaacggaaggcaagggcauauucgacgaagcuaagaaaaccgucgaggcacuuaacggauaccuagacaaacacaaagacgaggucgaccgagccagcgcagacagcaugauaaccaaccuacugaaacacaucgcaaaagcgcaagaacuauacaaaaacuccucagcccuccgagcccaaagcgcacaaaucgacacagcauucuccaguuacuacuggcucuacaaagcaggagucacccccgaaacauuccccacagucagccaauuccucuucgaacuaggaaaacaaccccgaggcacaaagaaaaugaagaaagcguuacucagcacccccaugaaauggggcaagaaacuauacgaacucuucgccgacgacuccuuccaacaaaaccgcauauacaugcacccggccguacuuaccgcaggacgcauaucagagaugggcgucugcuucgguaccauccccguggccaacccagacgacgcagcacaaggaucuggccacaccaaaagcauccucaaccuccgcacaaacaccgaaaccaacaacccaugcgcaaaaacaauagucaaacuauucgaaguccaaaagaccggcuucaacauccaagacauggacaucgucgcaucugaacaccuacuccaccaaagccuggucggaaaacaaucccccuuccaaaacgccuacaaugucaaaggcaacgcaaccuccgccaacaucaucuag

SEQ ID NO: 16921 - RNA, 1449 nt, Artificial Sequence
  derived and/or modified CDS sequence (opt11) from CCHFV(Turkey-Kelkit06)__GQ337053.1__N
auggaaaacaaaauagaagucaacuccaaagacgaaaugaacaaaugguucgaagaauuuaaaaaaggcaacggccuaauggacacauucaccaacucuuacuccuucugcgaaaacguccccaaccucgacaaauucgucuuccaaauggccuccgccaccgacgacgcccaaaaagacucaaucuacgccuccgcccuagucgaagccacgaaauucugcgccccaaucuacgaaugcgccuggguaagcuccaccggcauagugaaaaagggcuuagaaugguucgagaaagacuccggaaccauaaaaucaugggacgaaaacuacgcagaacucaaaguagacguacccaaaaucgagcaacucgccaacuaucagcaagcagcccuaaaauggcgcaaagacauagguuuccgcguaaacgccaacaccgccgcccucucaaacaaaguccucgccgaauacaaagucccgggagaaaucgugaugucagucaaagaaaugcuaagcgacaugauccgccgccgcaaucuaauccucaaccgcgguggagacgaaaacccccgagggcccgucagccgagaacacgucgaauggugcagagaauuuguaaaaggcaaauacauuauggcauuuaacccaccauggggcgacaucaacaagucaggacgaaguggaaucgcacucgucgccacaggccucgccaaacucgcagaaaccgaaggaaaaggcgucuucgacgaagcaaaaaaaaccgucgaggcccuuaacggauaccucgacaaacaccgcgacgaagucgacaaagccuccgcggacuccaugauaacaaaccucccaaaacacaucgcgaaagcccaagaacucuacaaaaacuccucagcacucagagcccaaggagcccaaauugacaccccguucuccagcuucuacuggcuuuacaaagcaggcgucacccccgaaacauuccccaccaucagccaguuccuauucgaacucggagaacaaccaagaggaacaaaaaaaaugaaaaaggcccuccucuccacacccaugaaauggggaaaaaaacuguacgaacucuucgccgaugacucauuccaacaaaaccgcaucuacaugcacccugccguccucaccgccggccgcauaagcgaaaugggggucugcuucggcaccauacccgucgccaauccagacgaugcagcccaaggcuccggacauaccaaaagcauccugaaccuccgaaccagcacagaaaccaacaaccccugcgccaagacaaucgucaagcuauuugaaauccaagaaaccggcuucaacauacaggacauggacaucgucgccucggaacaccuccuccaccaauccaucgucggaaaacaaagucccuuccagaacgcauacaacgucaaaggcaacgccacauccgccaacaucaucuaa

SEQ ID NO: 16922 - RNA, 5055 nt, Artificial Sequence
  derived and/or modified CDS sequence (opt11) from CCHFV(10200)__U39455.2__GP
augcacaucagccugauguacgccaucuuaugccuacagcugugcggccucggggaaacccacggcucccacaacgagacccgccacaacaagacggacaccaugaccacccacggggacaaccccagcuccgagccgcccgugagcacggcccuguccaucacccuggaccccagcaccgucacccccacgaccccggcguccggccucgaggggagcggcgagguguacaccuccccgcccaucaccacgggcagccugccccuguccgagaccacccccgagcuccccgugaccacggggaccgacacccugagcgccggcgaugucgaccccuccacccagacggccgggggcaccagcgcccccaccgugcggacgucccugccgaacagccccucgacgcccagcacgccccaggacacccaccacccggugcgcaaccuccuguccgucaccagccccgggcccgacgagaccagcaccccguccggcaccggcaaggagagcuccgccaccagcuccccgcacccagugagcaaccggccucccacgccacccgcgaccgcccaggggcccaccgagaacgacucccacaacgccaccgagcaccccgagagccugacgcaguccgccacccccggccucaugaccagccccacccagaucgugcacccccaguccgcgaccccgaucacgguccaggacacccaccccagccccaccaaccgcuccaagcggaaccugaagauggagaucauccugacccucagccaggggcugaagaaguacuacggcaagauccugcgccuccugcagcuaacgcucgaggaggacacggagggccugcucgaauggugcaagcggaaccucgggcuggacugcgacgacaccuucuuccagaagcggaucgaggaguucuucaucaccggcgaggggcacuucaacgaggugcugcaguuccggacgcccggcacccucuccacuaccgagagcacgccggccgggcugcccaccgccgagcccuucaaauccuacuucgccaaggguuuccugagcaucgacuccggcuacuacagcgccaagugcuacagcgggaccuccaacagcggccuccagcugaucaacaucacccgccacuccacucggaucguagacacccccgggccgaagaucacgaaccugaagaccaucaacugcaucaaccucaaggcgagcaucuucaaggagcaccgagagguggagaucaacgugcugcugccccagguggccgucaaccucuccaacugccacguggugaucaagagccacgugugcgacuacucccuggacaucgacggcgccgugcggcugccccacaucuaccacgaggggguguucauccccggcacguacaagaucgucaucgacaagaagaacaagcucaacgaccgcuguacccuuuucaccgacugcgugaucaagggacgggaggugcgcaagggccagagcguccugcggcaguacaagacugagauccgcaucggcaaggccuccaccggguuccggcgccuccugagcgaggaaccguccgacgacugcgugagccggacccagcuguuacgcacagagaccgccgagauccacggcgacaacuacgggggccccggcgacaagaucacgaucugcaacggguccaccaucgucgaccagcgccugggcagugaacuggggugcuacaccaucaaccgggugcgcuccuucaaacugugcgagaacagcgcgaccggcaagaacugcgagaucgacuccgugcccgucaagugccggcagggcuacugccuccgcaucacgcaggaggggcguggccacgugaagcugagccgcgggagcgaggugguccuggacgccugcgacaccuccugcgagauaaugauccccaagggcaccggggacauccuaguggacugcagcgggggccagcagcacuuccugaaggacaaccugaucgaccucgggugcccgaagaucccccugcugggcaagauggccaucuacauuugccggauguccaaccaccccaagaccacgauggccuuccucuucugguucagcuucggguacgugaucacgugcauccugugcaaggcuaucuucuaccugcucaucaucgucggcacccuggggcgccggcugaagcaguaccgugagcucaagccccaaaccugcaccaucugcgagaccaccccgguaaacgcgaucgacgccgagaugcacgaccugaauugcuccuacaacaucugccccuacugcgccucccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguuuaccgugagccuguccccggugcagagcgcgcccaucgggcagggcaagaccaucgaggccuaccgggcccgcgagggguacaccuccaucugccucuucguccugggcagcauccuguucaucguguccugccucaugaagggucugguggacagcgucgguaacuccuucuuccccggccugagcaucugcaagacgugcagcaucuccagcaucaacggguucgagaucgagucccacaagugcuacugcagccucuucugcugcccguacugucggcacugcuccaccgacaaggagauccacaaacugcaccugagcaucugcaagaagcgcaagaccggcuccaacgugaugcucgcugugugcaaacugaugugcuuccgcgcgaccauggagguaagcaaccgggcccuguucauccgcuccaucaucaacacgaccuucgugcucugcauccuuauccuggccgugugcgucgugagcaccuccgccguugagauggagaaccuccccgccgggaccugggagcgggaggaggaccugacgaacuucugccaccaggagugccaagucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcugucauggagcagcguggagcaccggggaaacaaaauccucguguccggccgcagcgaguccaucaugaagcuggaggagcggaccgguaucagcugggaccuuggagucgaggacgccuccgagagcaagcuccugaccguguccgugauggaccuaagccaaauguacucccccgucuucgaguaccucagcggggaccgccagguggaagaauggcccaaggcgaccugcacgggcgacugcccggagcggugcggcugcaccuccagcacgugccugcacaaggaguggccccacucccgcaacuggaggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccaaugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggugugcaagcuccaguccugcacccacggggugcccggcgaccuccagguguaccacaucgggaaccugcugaagggcgacaaggucaacgggcaccugauccacaagauugagccccacuucaacacuagcuggaugagcugggacggcugcgaucuggacuacuauugcaacaugggcgacuggcccuccugcaccuacacaggggugacccagcacaaccacgccagcuucgugaaccuccugaacaucgagaccgacuacaccaagaacuuccacuuccacuccaagcgcgucacggcccacggcgacacgccccagcuugaccucaaggcccggccgaccuacggggcgggcgagaucaccgugcugguggagguagccgacauggagcugcacaccaagaagaucgagaucagcgggcucaaguucgccucccuggccuguaccggcugcuacgccugcagcuccagcaucuccugcaaagugcgcauccacguggacgagcccgacgagcuaaccguccacgucaagagcgacgaccccgaugugguggcggccucgucuuccuuaauggcccggaagcuggaguucggcaccgacucgacguucaaggccuucuccgccaugcccaagaccagccugugcuucuacaucguggagcgcgagcacugcaaguccugcagcgaggaagacaccaagaaaugcgugaacaccaagcucgagcagccgcaauccauccugaucgagcacaaggggacgaucaucggcaagcagaacuccacgugcaccgcgaaagccagcugcuggcuggaaagcgucaagagcuucuucuacgggcugaagaacaugcucuccggcauuuucggcaacguguucauggggaucuuucuguuccuggcccccuucauccuccugauccuguucuucauguucggcuggcggauccucuucugcuucaagugcugccgccgcacccgggggcuguucaaguaccgccaccugaaagacgacgaggagaccggcuaccggcgcauuaucgaaaagcucaacaacaagaaggggaagaacaagcugcuggacggugagcggcucgccgacggccgcauugccgagcuguucagcaccaagacccacaucggguaa

SEQ ID NO: 16923 - RNA, 5055 nt, Artificial Sequence
  derived and/or modified CDS sequence (opt11) from CCHFV(IbAr10200)__AF467768.2__GP
augcacaucagccugauguacgccauccucugccugcagcugugcggccucggggagacccacggcucccacaacgagacccgccauaacaaaaccgacaccaugacgacgcccggggacaacccgagcuccgagccgcccgucagcaccgcccugucgaucacccuggaccccagcacugucacgccgacgacccccgcguccggccucgaggggagcggagagguauacaccucaccgcccauaaccacgggcagccugccccuguccgagaccacccccgagcuccccgugaccacgggaaccgacacccucagcgccggcgacgucgaccccuccacccagacggccgggggcaccagcgccccgaccgugcggaccagccugccuaacucucccuccacgcccagcacgccgcaggacacccaccaccccgugcgcaaccuccuguccgucaccagccccgggcccgacgagacgagcaccccguccggcaccgggaaggaaagcuccgccacaagcagcccccaccccgugagcaaccggcccccgaccccgcccgcgaccgcccagggucccacagagaacgacucccacaacgccaccgagcacccggagagccugacucaguccgccacccccggccucaugaccagccccacccagaucgugcacccgcaguccgcgacccccaucacgguccaggauacucaccccagucccacgaaccgcuccaagcgaaaccugaagauggagaucauccugacccucagccaggggcugaagaaguacuacggcaagauccugcgccuccugcagcugacgcuagaggaggacaccgagggucugcuggaguggugcaagcggaaccucgggcuggacugcgaugacaccuucuuccagaagcgcaucgaggaguucuucaucaccggcgaggggcacuucaacgaggugcugcaguuccgaacgccgggaacccucuccaccacagagagcacgcccgccgggcugcccacggccgagcccuucaaguccuacuucgccaagggcuuccugagcaucgacuccgguuacuacagcgccaagugcuacagcgggacguccaacagcggccuccagcuuaucaacaucacccgccacuccacgcggaucgucgacaccccggggcccaagaucaccaaccugaagaccaucaacugcauaaaccucaaggcgagcaucuucaaggagcaccgcgaggucgagaucaacgugcugcugccccagguggccguaaaccucuccaacugccacguagugauaaagucacacgucugugacuacagucuggacaucgacggcgccgugcggcugccccacaucuaccacgaggggguguucaucccuggcacguacaagaucgucaucgacaagaagaacaaacucaacgaccgcugcaccuuauucacagacugcgugauaaagggccgggagguucgcaaggggcaaagcguccugcggcaguacaagaccgagauccgcaucgggaaggccuccacggggagccggcggcuccuguccgaggagcccagcgacgacugcauuucccggacccagcugcuccgcaccgaaaccgccgagauccacggcgacaacuacgggggccccggcgacaagaucacgauuugcaacggcagcaccaucguggaccagcgccugggcuccgagcuagggugcuacacgaucaaccguguccgcagcuucaagcugugcgagaacucggcuaccggcaagaacugcgagauugacucagugcccgugaagugccggcagggcuacugccuccguaucacucaggaggggcggggccacgugaagcugagccgcggguccgagguggugcucgacgccugcgacaccagcugcgagaucaugaucccuaagggcaccggggacauccucgucgacugcuccggcggccagcagcacuuccucaaggacaaccugaucgaucucggguguccuaagaucccccugcugggcaagauggccaucuacaucugccggaugagcaaccaccccaagaccacgauggcauuccucuucugguucuccuucggguaugugaucaccuguauccucugcaaggcuaucuucuaccuccuuaucaucguuggcacccuggggaagcgccugaagcaguaccgggagcucaagccgcagaccugcaccaucugcgagacgacccccgucaacgcgaucgacgccgagaugcacgaccugaacugcagcuacaacaucugccccuacugcgccucccgucugaccagcgacgggcucgcccggcacgugauucagugccccaagcgcaaagaaaagguggaggagaccgagcuguacuuaaaccucgaacggaucccgugggucgugcgcaagcugcugcagguauccgagagcacgggcgucgcccucaagcgguccagcuggcugaucguacugcucgugcuguucaccgucucccugagccccguacaguccgcgcccaucgggcagggcaagaccauagaagcguaccgcgcccgggagggguacacuucuauuugccucuucgugcugggcuccauccuguucaucgucaguugucucaugaaggggcucguggacucagugggcaacagcuucuucccgggccugagcaucugcaagacgugcucgaucagcuccaucaauggguucgagaucgagagccacaagugcuacugcucccucuucugcugccccuacugccgccacugcagcaccgacaaggagauccacaagcugcaccugucuauaugcaagaagcggaagaagggcagcaacgucauguuagccguuugcaagcugaugugcuuccgcgcgaccauggagguguccaaccgcgcccuguucauccggagcaucaucaacacuacguucguccucugcauacugauacuggccguguguguggucuccaccagcgccguggagauggagaaccuccccgccgggaccugggagcgcgaggaagaccugaccaacuuuugccaccaagagugccaagugacggagaccgagugccugugccccuacgaggcgcucguccugcggaagccgcuguuccucgacuccaccgccaagggcaugaagaaccugcugaacagcacaucccucgagacaagccuguccaucgaggcccccuggggcgccaucaacguucagagcacauacaagccgaccguguccaccgcuaacauugcacugagcuggagcuccgucgagcaccgcgggaacaagauccucgugagcggccgauccgagagcaucaugaagcuggaggagcgcacggggaucuccugggaccugggcguggaggacgccagcgaguccaagcuccugaccgucagcgucauggaccugucucagauguacagcccgguguucgaguaccucaguggggaccggcaggucggagaguggccgaaggcaaccugcaccggcgacugccccgagcgcugcgggugcacgagcucgacuugccugcacaaggaguggccccauagccggaacuggcgcugcaaccccaccuggugcuggggcguggggaccggcugcacgugcugcgggcuggacgucaaagaccucuuuaccgacuacauguucguaaaguggaagguggaguauaucaagaccgaggccaucgugugcgucgagcugaccagucaggaacggcaguguagccugaucgaggccggcacgcgauucaaccucggcccggugaccauaacccuguccgagccccggaacauccagcagaagcugcccccggagaucaucacccuccacccgcgcaucgaagaaggguucuucgaccugaugcacguccagaagguacugagcgccaguacagugugcaagcuccaguccugcacgcauggcgucccaggggaccuccagguguaccacaucggcaaucugcugaaaggggauaaggugaacggccaccugauccacaaaauagagccccacuucaacaccagcuggauguccugggacggcugugaccuggacuacuacugcaacaugggggacuggcccagcugcaccuacaccggcgucacgcagcacaaccacgccuccuucgucaaccuccugaacaucgagaccgacuacaccaagaacuuccacuuccacagcaagcgugugaccgcccacggggacacgccgcaguuagaccucaaagcccgccccacguacggcgcgggggagaucaccguacugguugagguggccgauauggagcugcacacuaagaagauugaaaucuccggccucaaguucgccucgcuggccugcacgggcugcuacgccugcuccucagggaucuccugcaagguccggauccacguagacgagcccgacgagcugacagugcacgucaagagcgacgaccccgacgugguggcggccuccagcucccucauggcccgcaagcuggaguucggcaccgacagcaccuuuaaggccuucuccgccaugccgaagacgagccugugcuucuacaucgucgagcgggagcacugcaaauccugcagcgaggaggacaccaagaagugcgugaacaccaaacucgagcagccccaguccauccugaucgagcacaaggggaccaucauaggcaaacagaacagcacgugcaccgcgaaggccagcugcuggcuggaguccgugaaguccuucuucuacggccugaagaacauguuauccgggaucuucggcaacgucuucauggggaucuucuuguuccuggcacccuucauucuccuuauccuguucuucauguucggcuggcgcauccucuucugcuucaagugcugccgccgcacccgcgggcuguucaaguaccggcaccugaaggacgacgaggagaccggauaucgccggaucaucgagaagcucaacaacaagaagggcaagaacaagcugcuggauggcgagcgccucgccgaccggcgcaucgccgaacuguucagcacgaagacccacaucggcuga

SEQ ID NO: 16924 - RNA, 5067 nt, Artificial Sequence
  derived and/or modified CDS sequence (opt11) from CCHFV(Turkey-Kelkit06)__GQ337054.1__GP
augcccaccaacauuaugcacaccccgcuggugugcuucauccucuaccugcagcuguuaugccugggcggggcccacggccaacugaacgccacggagcacaacgggaccaacaacacaacggcgcccggcgccagccagucccccaaacccccgaugagcacuacaccaccccacgcccccgaguccagcaccaucaagccgaccacgccaauuuccgaggccgaggggagcggagagaccaccuccccgcccaauaccacgcagggccucaguucccccgagaccaccagcgagcgcccugccaccacguccaucagcacuuccagcaccgacuccaccaaccccacgacgcagaugaccgacaacacccccacuccgaccgucucgaccucccccagcuccagccccagcacccccuccacuccgcaggggauccaccacccagcgcggagccugcuguccguuucuucccccaagaccgugaccacccccacgccgaccagccccggugagauguccagcgagaccuccagccagcacagcgccaugagccgcauccccacuccccacaccgcgacccggguauccaccgagaucaccaaccaccgcaccccgcggcagagcgagucaagcgcccagcagacgacgccuucccccaugaccagcccggcgcaguccauccuccugaugagcgccgcacccaccgccgugcaggacauccaccccagcccaacgaaccgcuccaagcggaaccuggaaaccgagaucauccucacccucagccaggggcugaagaaguacuauggcaagauucucaagcuccugcaccucacccuggagcaagacacggaggggcugcucgaauggugcaagggcaaccugggcuccaacugcgacgacgacuucuuccagaagaggaucgaggaguucuucaugaccggggagugcuacuucaacgaggugcugcaguucaagacccucagcacccuguccccgaccgagcccagccaugcccggcugcccaccgcggagcccuucaaguccuacuucgccaagggguuccugagcaucgacuccggguauuucagcgccaaaugcuacccgcgcuccagcgccucaggccugcagcugaucaacgucacccagcaccccgcccggaucgcugagacccccggccccaaaacgacuagccucaagaccaucaacugcaucaaucugcgcgccuccguguucaaggagcacagagagguggaaaucaacgugcugcucccgcagauagccgugaaccugagcaacugccacguggucaucaacucccacgugugcgacuacagccuggacaccgacgggcccgugcgucucccccgcaucuaccacgagggcacguucauccccgggacauacaagaucgucaucgacaagaagaacaagcugaacgaccgcugcacgcuggugacgaacugcgugaucaagggccgggagguccgcaaagggcagagcguguugcgucaguacaagaccgagaucaagaucggcaaggccuccaccggguuccgcaagcugcugagcgaggaaccgggggacgacugcaucucccggacccaacucuugcgcaccgagacggcugagauccacgacgacaacuacggcgggcccggcgacaaaaucaccaucugcaacggcucaacuauuguggaccagagacugggcuccgaguuaggcugcuacaccaucaaccgggucaagagcuuuaagcugugcaagaacuccgcgacggggaagaccugcgaggucgacagcacccccgugaagugccgucagggcuucugucucaagauuacccaggaggggcggggccacgugaagcugucccgcgggucagaggugguacuggacgccugcgacuccagcugcgaggugaugauccccaagggcacgggcgacauucuaguggacugcagugggggucaacaacacuuucuaaaagacaaccucaucgaccuggggugcccgcacaucccccugcucggccggauggccaucuauaucugccgcaugagcaaccacccccggaccacuauggccuucuuguuuugguucuccuuuggcuacgugauuaccugcaucuucugcaaggcccuguucuauucgcucaucaucaucggaacccuggguaagaagaucaagcaguaccgcgagcugaagccccagacgugcaccaucugcgagaccgcgccggugaacgccaucgacgccgagaugcacgaccucaacugcuccuacaacaucugccccuacugcgcgagcaggcugaccuccgacggacuggcgcgccacgugacgcaaugccccaagcggaaggagaaggucgaggagaccgagcucuaccugaaccuggagcgcaucccguggaucgugcggaagcucuuacaggugagcgagagcaccggcgucgcccugaagcgcuccagcuggcugaucgugcugcugguacuccugaccgucucccugagccccgugcaguccgcccccgucgggcacggcaagacgaucgagaucuaccagacccgggagggcuucgcuagcaucugccucuucaugcugggguccauccuauucaucgucagcugccucgugaagggccugguggacuccguuagcgaguccuucuuccccgggcugucggugugcaagacaugcuccaucggcagcgugaacggguucgagaucgagucccacaagugcuacugcagccucuucuguugcccguacugccgucacugcagugccgaccgggagauccaccagcuucaucugagcaucugcaagaagcgcaagaccggcuccaacgucaugcucgcugugugcaagcggaugugcuuccgcgccacgaucgaggcaagccgucgggcucugcugauacgcagcauaaucaacaccaccuucgugaucugcauccucacccugacgaucugcgucguguccaccagcgccguggagauggagaaccugcccgccggcaccugggagcgggaagaggaccucaccaacuucugccaccaggagugccaggucacggagaccgagugccugugccccuaugaagcccuggugcuccgcaagccccuguuucuggacuccaucgugaaggggaugaaaaaccuccugaacagcaccucccuggagaccagccuguccaucgaggccccguggggcgccaucaacgugcagagcacauucaagcccaccguguccacugccaacaucgcgcugagcuggucuagcgugguccaccgggggaacaagauccugguuaccggccgcuccgagagcaucaugaagcucgaggagcggacggggguauccugggaccugggcguagaggacgccagcgagucgaagcugcucaccgugagcaucauggaccugucccagauguacagccccguguucgaguaucugagcggcgaccgccagguagaggaguggcccaaggcuaccugcaccggugacugcccggagcggugcggcugcacgucgagcaccugucuccacaaggaauggucccacagccgcaacuggcggugcaaccccaccuggugcuggggcguggggaccggaugcacgugcugcggcguggacgucaaggaccuauuuaccgaccacauguucgugaaguggaagguggaauacaucaaaaccgaagccaucguuugcguggcgcugaccucccaggagcgccagugcagccucaucgaggccggaacccgguuuaaccuagggccggugacgauuacccucuccgagccccgcaacauccagcagaaacucccgcccgagauuaucacccugcaccccaaaaucgaggagggcuuuuucgaucugaugcacguccagaaggugcucagcgccuccaccgugugcaagcugcagagcugcacgcacgggauccccggcgaccugcaggucuaccauaucggcaaccuccugaagggggaccgcgugaacggccaccugauccacaagaucgagucccacuucaacaccagcuggauguccugggacgggugugaccucgacuacuacugcaacaugggcgacuggccgagcugcaccuacaccggggucacucagcacaaccacgccgccuucgugaaccugcugaacaucgagaccgacuacaccaagaccuuccacuuucacuccaagcgcguaacggcgcauggcgacaccccucagcucgaccugaaggcccggcccaccuacggcgccgggggcaucaccguccuggucgagguggcugacauggagcuccacacuaagaaggucgaaaucagcggacugaaguucgccucccucgcgugcaccggcugcuacgccugcagcagugggaucagcugcaagguacgcauccacguggacgagccggacgagcucacuguccacguaaagagcagcgacccggacgugguugccgcgucgaccucacugauggcccggaaacuggaguucggcacggacucaacguuuaaggcguucuccgccaugcccaagaccagccucugcuucuacaucguggagcgcgaguacugcaaguccugcagcgaggacgacacccagaaguguguggacacgcggcuggagcaaccccaguccauacugaucgagcacaaaggcacaaucaucgggaagcagaacgauaccugcaccgccaaggccagcugcuggcucgaguccgucaagaguuucuucuacggccugaagaacaugcugggguccguguucggcaaccuauucaucgggauccuccuguuccucgcgcccuucguguuacucguccuguuuuucauguucggcuggaagauccucuucugcuucaaguguugccgccgcacgcggggccuguucaaguaccgccaccugaaggacgacgaggagaccggguaccggagaaucaucgagcgacucaauagcaagaagggcaagaaccgccugcuggacggggaccgacucgccgaccgcaagauagccgagcuauucuccaccaagacccacaucggcuga

SEQ ID NO: 16925 - RNA, 3579 nt, Artificial Sequence
  derived and/or modified CDS sequence (opt11) from CCHVF(10200)__U39455.2__SP-GP_Gn-NSm-Gc
augcacaucagccugauguacgccauccucugccugcagcugugcggccucggggagacccacggcucccacaacgagaccagcgaggagcccuccgacgacugcgugagccgcacgcagcugcugcggaccgagaccgccgagauccacggggacaacuacggcgggccgggcgacaagaucaccaucugcaacggcuccacgaucgucgaccagcgccucgggagcgagcugggcugcuacaccaucaaccgggugcgcuccuucaagcugugcgagaacagcgcgaccgggaagaacugcgagaucgacuccgugcccgucaagugccggcagggcuacugccuccgcaucacccaggaggggcggggccacgugaagcugagccgcggcuccgaggugguccuggacgccugcgacacgagcugcgagaucaugauccccaaggggaccggcgacauccucguggacugcuccgggggccagcagcacuuccugaaggacaaccugaucgaccucggcugccccaagaucccgcugcuggggaagauggccaucuacaucugccggaugagcaaccaccccaagaccaccauggccuuccucuucugguucuccuucggcuacgugaucacgugcauccugugcaaggccaucuucuaccugcucaucaucgucgggacccugggccgccggcugaagcaguaccgcgagcucaagccccagaccugcaccaucugcgagacgacccccgugaacgcgaucgacgccgagaugcacgaccugaacugcagcuacaacaucugcccguacugcgccucccggcugaccagcgacgggcucgcccgccacgugauccagugccccaagcggaaggagaaggucgaggagaccgagcuguaccugaaccucgagcgcauccccuggguggugcggaagcugcugcaggucuccgagagcacgggcguggcgcucaagcgcagcuccuggcugaucgugcugcucguccuguucaccgugagccugucccccgugcagagcgccccgaucggccaggggaagaccaucgaggccuaccgggcccgcgagggcuacaccuccaucugccucuucguccuggggagcauccuguucaucguguccugccucaugaagggccugguggacagcgucgggaacuccuucuuccccggccugagcaucugcaagacgugcuccaucagcuccaucaacggcuucgagaucgagagccacaagugcuacugcucccucuucugcugccccuacugccggcacugcagcaccgacaaggagauccacaagcugcaccuguccaucugcaagaagcgcaagaccgggagcaacgugaugcucgccgucugcaagcugaugugcuuccgcgcgaccauggagguguccaaccgggcccuguucauccgcagcaucaucaacacgaccuucgugcugugcauccucauccuggccgucugcguggugagcaccuccgccgucgagauggagaaccugcccgccggcaccugggagcgggaggaggaccucacgaacuucugccaccaggagugccaggugaccgagaccgagugccugugcccguacgaggcgcuggugcuccgcaagccccuguuccuggacagcaccgccaaggggaugaagaaccuccugaacuccacgagccuggagaccucccucagcaucgaggcccccuggggcgccaucaacguccaguccaccuacaagcccaccgugagcaccgccaacaucgcgcuguccuggagcuccguggagcaccgggggaacaagauccuggucagcggccgcuccgagagcaucaugaagcucgaggagcggacgggcaucuccugggaccuggggguggaggacgccagcgaguccaagcugcucaccgugagcgucauggaccugagccagauguacuccccgguguucgaguaccugagcggcgaccgccagguggaggaguggcccaaggccaccuguaccggggacugccccgagcggugcggcugcacguccagcacaugccuccacaaggaguggccccacucccgcaacuggcggugcaacccgaccuggugcuggggcgucgggaccggcugcacgugcugcgggcuggacgugaaggaccuguucaccgacuacauguucgugaaguggaaggucgaguacaucaagaccgaggccaucgugugcguggagcucaccagccaggagcgccagugcucccugaucgaggccggcacgcgguucaaccuggggcccgucaccaucacccucagcgagccccgcaacauccagcagaagcugcccccggagaucaucacccugcacccccggaucgaggagggcuucuucgaccucaugcacgugcagaaggugcuguccgcgagcacggucugcaagcugcaguccugcacccacggcgugcccggggaccuccagguguaccacaucggcaaccugcugaagggggacaaggucaacggccaccucauccacaagaucgagccgcacuucaacaccagcuggauguccugggacgggugcgaccuggacuacuacugcaacaugggcgacuggcccagcugcaccuacacgggcgugacccagcacaaccacgccuccuucgugaaccugcucaacaucgagaccgacuacaccaagaacuuccacuuccacagcaagcgcgucacggcccacggggacaccccccagcuggaccugaaggcccggcccaccuacggcgcgggggagaucaccgugcucguggaggucgccgacauggagcugcacacgaagaagaucgagaucuccggccugaaguucgccagccucgccugcaccgggugcuacgccugcuccagcagcaucuccugcaaggugcgcauccacguggacgagccggacgagcugaccguccacgugaagagugacgaccccgacguggucgcggccuccagcucccugauggcccggaagcucgaguucggcaccgacagcacguucaaggccuucuccgccaugcccaagaccagccugugcuucuacaucguggagcgcgagcacugcaaguccugcagcgaggaggacaccaagaagugcgugaacaccaagcuggagcagccccaguccauccucaucgagcacaagggcacgaucaucgggaagcagaacagcacaugcaccgcgaaggccuccugcuggcuggagagcgucaaguccuucuucuacggccugaagaacaugcucagcgggaucuucggcaacguguucauggggaucuuccuguuccuggccccguucauccuccugauccuguucuucauguucggcuggcgcauccucuucugcuucaagugcugccggcgcacccggggccuguucaaguaccgccaccugaaggacgacgaggagaccggguaccggcgcaucaucgagaagcucaacaacaagaagggcaagaacaagcugcuggacggggagcggcucgccgacggccgcaucgccgagcuguucuccacgaagacccacaucggcuga

SEQ ID NO: 16926 - RNA, 3552 nt, Artificial Sequence
  derived and/or modified CDS sequence (opt11) from CCHVF(10200)__U39455.2__IgE-leader_Gn-NSm-Gc
auggacuggaccuggauccuguuccucguggcagccgcgacucgcguacacucauccgaggagcccagcgacgacuguguguccagaacgcagcuguugcgcacggagacggccgagauccacggcgacaacuacgggggcccgggggacaagaucaccauaugcaacggcagcaccaucguagaccagcggcucggguccgagcuaggcuguuacaccaucaaccguguccggagcuucaagcugugcgaaaauucagccaccggcaaaaacugcgagaucgacagcguucccgugaagugucgccagggguacugccuccggaucacccaggagggcagagggcacgucaaguuaucucggggcagcgagguagugcuggacgcgugcgacacguccugcgagaucaugauacccaaggggaccggcgacauccucgucgacugcagcggcgggcaacagcacuuccugaaggacaaccugaucgaucucggcugccccaagaucccgcuacuggggaaaauggccaucuacaucugccgaauguccaaccacccaaagaccaccauggcguuccucuucugguucagcuucggguacgugaucacaugcauucugugcaaggccaucuucuaccugcucaucaucgugggcacccuggggcggcgccugaaacaguacagagagcucaagccccagaccugcaccaucugcgagaccaccccggucaacgcgauugaugccgagaugcacgaccuaaacuguuccuacaacaucugcccguacugcgcgagccgccugacguccgacggccucgcccggcacgugauccagugccccaagcgcaaggagaagguggaggagaccgaguuauaccucaaccuagagcggaucccuugggucguucggaaguugcuccaggugagcgaguccacggggguugcccucaagaggagcagcuggcugaucgugcugcucguacuguucaccgucagucugagccccgugcaguccgcuccgaucgggcaggggaagaccaucgaggcguaucgggccagggagggcuacaccagcaucugccucuucguccugggcuccauccuguucaucgucagcugccugaugaaggggcugguggacagugucggcaacagcuucuuccccgggcuaagcaucugcaagacgugcagcaucuccuccaucaacggcuucgagaucgaaucccacaagugcuacugcucccucuucugcugccccuacugccgccauugcuccaccgacaaggagauccacaagcugcaccugucaaucugcaagaagaggaaaaccggguccaacgugaugcuagccgugugcaagcugauguguuuccgggcuaccauggaggucagcaaccgcgcccuguucauuagguccauuaucaauaccacuuucgugcucugcauccugauccuggcggugugcgucgugagcaccagcgcaguggaaauggagaaccuaccugccggcaccugggagcgggaggaggaucucacgaacuucugccaccaggagugucaggucacagagaccgagugccuuugcccguacgaggcccugguacucaggaagccccuguuucuggacuccaccgccaagggcaugaaaaaccuccugaacuccacaucccuggagaccagccucuccauagaggcccccuggggcgcgaucaacgugcagucaaccuacaaacccaccgucuccaccgcuaacauugcccugagcugguccucgguggagcacagggggaacaagauucugguguccgggcggucagagagcaucaugaagcucgaggagcgcacgggcaucagcugggaucugggggucgaagaugccuccgagagcaaguugcucacagugaguguaauggaccugagccagauguacagcccgguuuucgaguaccuguccggcgaccgccagguggaagaguggcccaaggcaacuugcacaggcgacugccccgagcggugcgggugcacgagcucgaccugccuucauaaagaguggccacacagccggaacuggcgcugcaacccgaccuggugcuggggcguggggaccggguguacgugcugcgggcuggacgucaaggaccuguucaccgacuacauguucgugaaguggaagguggaguacaucaagaccgaggcgaucgucugcguggagcucaccucgcaggagcgucagugcagccugaucgaggccgggacgcgcuucaaccugggccccgugaccaucacccucuccgaaccgcggaacauccaacaaaagcugccaccggagaucaucacccugcacccccgcauugaggagggcuucuucgaccucaugcacguccaaaaggugcugagcgcaucuacugugugcaaacugcagagcuguacccacggaguacccggggaccuccaaguauaccacaucgguaaucugcugaagggagacaaggugaacgggcaucucauccacaagaucgagccgcacuucaauaccuccuggaugagcugggacggcugcgaccuggauuacuauugcaacaugggggacuggccguccugcacuuauacgggcguuacucagcacaaucacgccagcuucgugaaccuacucaacauagagaccgacuacaccaaaaauuuccacuuucacuccaagcgggugacagcacacggggacacuccccaacuggaccugaaggcccgccccaccuauggcgccggagagauaacgguccucguggagguggccgacauggagcugcacacgaagaagaucgagaucagcggguugaaguucgccucccucgccugcaccggaugcuaugcgugcagcuccagcaucucaugcaagguccggauccacguggacgagccggacgagcugaccgugcacguaaaaagcgacgaccccgaugucguggccgccagcuccagccugauggcgcgcaaacucgaguucgggaccgacuccaccuucaaggcguucagcgcaaugcccaagacgagccugugcuucuacaucgucgagagagagcacugcaagagcugcucagaggaggacaccaaaaagugcgugaacaccaagcuggagcagccccagagcauccuaaucgaacauaaggggacaaucaucgggaagcagaacuccacuugcaccgcgaaagccucuugcuggcuagagucuguaaagagcuucuucuacgggcuaaagaacaugcucuccggcaucuucgggaauguuuucaugggcaucuucuuauuccucgcgcccuucauccuccugauccuguucuuuauguucggauggcggauucuguucuguuucaagugcugccgccggacccgcggccuuuucaaguacagacauuugaaagacgacgaggagaccggguacagaagaaucaucgagaagcucaacaacaagaaaggcaagaacaagcugcuggacggcgaacggcucgcugacgggcggaucgccgaacucuucagcacgaagacccauauuggcuga

SEQ ID NO: 16927 - RNA, 2973 nt, Artificial Sequence
  derived and/or modified CDS sequence (opt11) from CCHVF(10200)__U39455.2__IgE-leader_Gn-4aa-Gc
auggacuggaccuggauccucuuucugguugccgcagccacccgcguucacuccagcgaagaacccucggacgacugcguuaguagaacucaacuccuacggacagaaaccgcagagauccacggcgauaacuacggcggccccggcgacaagauuacuaucugcaacggcagcaccaucgucgaccaacgacucggcucagaacuaggcugcuacaccauuaaccgcguccgcagcuucaaacuaugcgagaacagcgcgaccgggaagaacugcgaaaucgacucaguaccugucaaaugcagacaaggauacugccugcgaaucacccaagaaggucgcggacacgucaagcuaucccgcggaucagaaguuguucuggacgcgugcgacaccaguugcgaaaucaugauaccaaaaggcaccggugacauucucguagacugcagcggcggccaacaacacuuuuuaaaagacaaccucaucgaccucggaugcccaaaaauaccucuccucgguaaaauggcuaucuacauaugcaggaugucuaaccaucccaaaacaacgauggcuuuccuuuucugguucuccuuuggguacgucauaaccugcauacucugcaaagcaaucuucuaccuccucaucaucguagggacacuaggacgccgauuaaaacaguaccgcgagcuaaaaccacaaacaugcacaauuugcgagacaacaccagucaacgcaaucgaugcugaaaugcacgaccucaacuguucauauaacaucugccccuacugcgccucgcgucuaaccucagacggccucgccagacacgucauccaaugccccaagcgcaaggaaaaggucgaagaaaccgaacuauacuugaaccuagaacgcaucccguggguugucagaaaacugcuucaggucucagaaucuaccggaguagcccucaagcgcucauccuggcucauuguacugcucguacucuuuaccgugagcuuaagcccaguccaauccgcccccaucggccgaaaaccacuauuccucgauuccacagccaaagguaugaaaaaccuccucaauucgaccucccucgaaaccucccucucgaucgaagcccccuggggcgccauaaacguccaauccacuuacaaaccuacugugucuacagcaaauaucgcccuauccuggucuuccguagagcaccgcgggaacaaaauacucguaucuggccgcuccgagagcaucaugaagcucgaagaacgcaccggaaucuccugggaccuuggcguagaggaugcgucagaaucaaagcuccuuaccgucagcgucauggaccuaucgcaaauguacuccccagucuucgaauaccugagcggcgaccgccagguggaagaguggcccaaagcaaccugcaccggggacugccccgaacggugcgguugcacuucgucaacaugccuucacaaagaauggccccacagccggaacuggcgcuguaaccccacauggugcuggggcgucgguaccggauguacaugcugcggacuugauguaaaggaccuuuucaccgacuauauguucguuaaguggaagguugaauacaucaaaacagaagcaauagucugcgucgagcucacaucccaagagcgucaaugcucccuaauagaagcuggaacccgcuuuaacuuagguccggucacaauaacacuaucagaaccucgcaauauccaacaaaagcucccucccgaaaucaucacccuucacccccgcaucgaagaaggauucuucgaccucaugcacguccaaaaagugcucagcgccagcacagucuguaaacuccaauccuguacccacggcguacccggagaccuacaaguuuaucacauagggaaucuccuaaaaggggacaaagucaauggccaccucauacacaaaaucgagccacacuucaacaccagcuggauguccugggacgggugcgaucuagacuacuacugcaacaugggggacuggcccucuugcaccuacacgggagucacacagcacaaucacgccucauucguaaaccuucuaaacaucgaaacggacuacacuaaaaauuuccacuuccacucgaaaagggucacagcacacggcgacacaccccagcucgaccucaaagcccgccccaccuacggcgcaggagaaaucacaguacucguugaaguagccgacauggagcuacauaccaagaaaaucgaaaucucaggacucaaauuugccucacuagccugcacgggcugcuacgcaugcucaucuuccaucuccugcaaaguacgcauccacgucgacgaaccagacgagcucaccguccaugucaaaagcgaugacccagacguggucgccgcuuccagcucucuuauggcucgaaaacuagaguucggcacagacuccaccuucaaggcuuucucggccaugcccaaaaccucgcucugcuucuacaucguugagcgggagcacuguaaauccugcuccgaagaagauaccaaaaagugcgucaacaccaaacucgagcaaccgcaguccauucucaucgaacacaaaggcacaaucaucggaaaacaaaacagcacaugcaccgccaaggcauccuguuggcuugaaagcgugaaguccuucuucuacggacucaaaaacaugcuauccggcaucuucggcaacgucuucaugggaaucuuccuguuucuggcccccuuuauacuccuaauacucuucuucauguucggauggcgcauccucuuuugcuucaaauguugcagacgaacacgcggccucuucaaauaccgccaccucaaagacgacgaagaaacgggcuaucgcagaauaaucgaaaaauugaacaacaagaaaggcaaaaacaaacuccuggacggagaacgauuagccgacggcaggauagccgaacuauuuucaaccaaaacgcacauagguuaa

SEQ ID NO: 16928 - RNA, 1029 nt, Artificial Sequence
  derived and/or modified CDS sequence (opt11) from CCHVF(10200)__U39455.2__IgE-leader_Gn
auggacuggaccuggauccucuuccuaguugccgccgcuacccgcguccacuccucagaggaacccuccgacgacugcgucucccgcacucaacucuuacgcaccgaaacagccgagauccacggcgacaacuacgggggacccggcgacaaaaucaccauaugcaacggcuccaccaucgucgaccaacgccucggcucagaacucggcugcuacacgaucaaccgaguccgcucuuucaaacucugugaaaacucagcaaccggcaaaaacugugaaaucgacuccguacccgugaaaugcagacaaggauauugccuccgaaucacccaagaaggacgcggccacgucaaacucagccgaggcucagaagucguccucgacgccugcgacaccucaugcgaaaucaugauccccaaaggaaccggcgacauccucgucgacugcuccggcggccaacaacacuuccuuaaagacaaccucauagaccucggaugccccaaaauaccucuacuagggaaaauggccaucuacauaugccgcauguccaaccaccccaaaacaacuauggccuuccuuuucugguucucguucggcuacgucaucacaugcauccucugcaaagccaucuuuuaccuacuuaucaucguaggcacccuaggccgccgucuaaaacaauaccgcgaacucaaaccccaaaccugcaccaucugcgaaaccacccccguaaacgccaucgacgcagaaaugcacgaccuaaacugcuccuacaacaucugcccauacugcgccucccgccuaaccuccgacggacucgcccgccacgucauccaaugccccaaacgcaaagaaaaaguagaagaaacagaacuauaccuaaaccuagaacgcauaccgugggucguccguaaacuccuccaagucucagaauccaccggcgucgcacucaaacgaucaagcuggcuaaucguccuccucguccucuucaccgucucacuaucccccguccaauccgcccccaucggcuaa

SEQ ID NO: 16929 - RNA, 1989 nt, Artificial Sequence
  derived and/or modified CDS sequence (opt11) from CCHVF(10200)__U39455.2__IgE-leader_Gc
auggacuggaccuggauccucuuccucgucgccgccgcaacacgcguucacagcuuccucgacagcaccgccaagggcaugaaaaaccuacucaacucgaccucccuagagacaucccucuccaucgaagcccccuggggagccaucaacguccaauccaccuacaaaccaaccguguccacggccaacauagcgcuaagcugguccagcgucgagcaccgaggaaacaagauccuagucucgggccgaagcgaaucaauaaugaagcucgaggaacgcacgggaaucucaugggaucucggcgucgaagacgcaagcgaaucaaaacuccuuacagugagcgucauggaccuuucacaaauguacucgcccguauucgaauaccuuagcggagaccgccaaguugaagaguggcccaaagcgaccugcaccggcgacugccccgaacguuguggcuguacaucgagcacaugccuacacaaagaauggccacauuccagaaacuggcgcugcaacccgaccuggugcuggggcgugggcacaggcugcacaugcugcggccuugacgucaaagaccuauucaccgacuacauguucgucaaauggaaaguagaauacauaaaaaccgaagcaauagucugcgucgaacuaaccucccaagaacgacaaugcucacucauagaagcuggaacccgcuucaaccucggacccguaacgaucacucucuccgaaccccgaaacauccagcaaaaacucccucccgaaaucauaacccuacacccacguaucgaagaaggcuucuucgaccuaaugcacgugcaaaaaguacucagcgcguccaccguuugcaaacuccaaucuugcacucacggcguacccggcgaccugcaagucuaccacaucggcaaccuccucaagggcgacaaaguaaauggucaccugauccacaaaaucgagccccacuucaacaccuccuggaugagcugggacggaugcgaccucgacuacuacugcaacaugggagacuggcccucaugcacguacaccggcgucacccaacacaaccacgccucauucguaaaccugcugaacaucgaaaccgacuauaccaagaacuuccacuuccacagcaaaagagucaccgcccacggcgacacaccccaauuagaccucaaagcccgccccaccuacggcgccggcgaaauaaccguccucgucgaagucgcagacauggaacuacacacaaagaaaauagaaauuuccggccugaaauucgcaucacucgcaugcacaggcugcuacgcgugcucaagcucaauauccuguaaaguccgaauccacguagaugaaccagacgagcucaccguacacgucaagucagacgacccagacguaguagcggccucauccucccucauggcacgaaaacuagaguucggcacagacucaacauucaaagcauucagcgcaaugccaaaaaccucccuuugcuucuacaucgucgaacgcgaacacugcaaaagcugcagcgaagaagacacaaagaaaugcguuaacaccaaacuugaacaaccccaaagcauccugauagaacacaaaggcacuaucaucggaaagcagaacucaaccugcacugccaaggccagcugcuggcucgaaagcgugaaaucauucuuuuacggacugaaaaacaugcuaagcggcauuuucgguaacguauucaugggcaucuuccucuuccuggccccguucauccucuuaauacuauuuuucauguucggcuggagaauccuauucuguuucaaaugcugccgccgcacgcgcggccuuuuuaaauaucgccaccuuaaggacgaugaagaaaccggcuaccgccgaauaauagaaaaacuaaacaacaaaaagggcaaaaacaaacuccucgacggcgaacgccuugcagacggccgcauagccgaacucuucagcacaaaaacccacauaggcuga

SEQ ID NO: 16930 - RNA, 1666 nt, Artificial Sequence
  mRNA product Design1 comprising derived and/or modified sequence from CCHFV(10200)__NC_005302.1/U88410.1__N (wt)
gggagaaagcuuaccauggaaaacaagaucgaggugaauaacaaagaugagaugaacaggugguuugaagaguucaaaaaaggaaauggacuuguggacaccuucacaaacuccuauuccuuuugcgagaguguucccaauuuggacagguuuguguuucagauggccagugccaccgaugaugcacagaaggacuccaucuacgcaucugcucugguggaggcaacaaaguuuugugcaccuauauaugagugcgcauggguuagcuccacuggcauuguaaaaaagggacuugaaugguucgagaaaaaugcaggaaccauuaaguccugggaugaaaguuauacugagcuaaaggucgacgucccgaaaauagagcagcuuaccgguuaccaacaagcugccuugaaguggagaaaagacauagguuuccgugucaaugccaacacagcagcucugagcaacaaaguccucgcagaauacaaagucccuggugagauugugaugucugucaaagagaugcugucagacaugauuaggagaaggaaccugauucuaaacagggguggugaugagaacccacguggcccagugagccaugagcauguagacuggugcagggaguuugucaaaggcaaauacaucauggccuucaacccaccauggggggacaucaacaagucaggccguucaggaauagcacuuguugcaacaggccuugcuaagcuugcagagacugaaggaaagggaauauuugaugaagccaaaaagacuguggaggcccucaacggguaucuggacaagcauaaggacgaaguugauagagcaagcgccgacagcaugauaacaaaccuucuuaagcauauugccaaggcacaggagcucuauaaaaauucaucugcacuucgugcacaaagcgcacagauugacacugcuuucagcucauacuauuggcuuuacaaggcuggcgugacuccugaaaccuucccgacggugucacaguuccucuuugagcuagggaaacagccaagagguaccaagaaaaugaagaaggcucuucugagcaccccaaugaagugggggaagaagcuuuaugagcucuuugccgaugauucuuuccagcagaacaggauuuacaugcauccugccgugcuuacagcugguagaaucagugaaaugggagucugcuuugggacaaucccuguggccaauccugaugaugcugcccaaggaucuggacacacuaagucuauucucaaccuccguaccaacacugagaccaauaauccgugugccaaaaccaucgucaagcuauuugaaguucaaaaaacaggguucaacauucaggacauggacauaguggccucugagcacuugcuacaccaaucccuuguuggcaagcaauccccauuccagaacgccuacaacgucaagggcaaugccaccagugcuaacaucauuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16931 - RNA, 1666 nt, Artificial Sequence
  mRNA product Design1 comprising derived and/or modified sequence from CCHFV(10200)__NC_005302.1/U88410.1__N (wt)
gggagaaagcuuaccauggaaaacaagaucgaggugaauaacaaagaugagaugaacaggugguuugaagaguucaaaaaaggaaauggacuuguggacaccuucacaaacuccuauuccuuuugcgagaguguucccaauuuggacagguuuguguuucagauggccagugccaccgaugaugcacagaaggacuccaucuacgcaucugcucugguggaggcaacaaaguuuugugcaccuauauaugagugcgcauggguuagcuccacuggcauuguaaaaaagggacuugaaugguucgagaaaaaugcaggaaccauuaaguccugggaugaaaguuauacugagcuaaaggucgacgucccgaaaauagagcagcuuaccgguuaccaacaagcugccuugaaguggagaaaagacauagguuuccgugucaaugccaacacagcagcucugagcaacaaaguccucgcagaauacaaagucccuggugagauugugaugucugucaaagagaugcugucagacaugauuaggagaaggaaccugauucuaaacagggguggugaugagaacccacguggcccagugagccaugagcauguagacuggugcagggaguuugucaaaggcaaauacaucauggccuucaacccaccauggggggacaucaacaagucaggccguucaggaauagcacuuguugcaacaggccuugcuaagcuggcagagacugaaggaaagggaauauuugaugaagccaaaaagacuguggaggcccucaacggguaucuggacaagcauaaggacgaaguugauagagcaagcgccgacagcaugauaacaaaccuucuuaagcauauugccaaggcacaggagcucuauaaaaauucaucugcacuucgugcacaaagcgcacagauugacacugcuuucagcucauacuauuggcuuuacaaggcuggcgugacuccugaaaccuucccgacggugucacaguuccucuuugagcuagggaaacagccaagagguaccaagaaaaugaagaaggcucugcugagcaccccaaugaagugggggaagaagcuguaugagcucuuugccgaugauucuuuccagcagaacaggauuuacaugcauccugccgugcuuacagcugguagaaucagugaaaugggagucugcuuugggacaaucccuguggccaauccugaugaugcugcccaaggaucuggacacacuaagucuauucucaaccuccguaccaacacugagaccaauaauccgugugccaaaaccaucgucaagcuauuugaaguucaaaaaacaggguucaacauucaggacauggacauaguggccucugagcacuugcuacaccaaucccuuguuggcaagcaauccccauuccagaacgccuacaacgucaagggcaaugccaccagugcuaacaucauuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16932 - RNA, 1666 nt, Artificial Sequence
  mRNA product Design1 comprising derived and/or modified sequence from CCHFV(Turkey-Kelkit06)__GQ337053.1__N (wt)
gggagaaagcuuaccauggaaaacaagaucgaggugaacagcaaggaugagaugaacaaaugguuugaggaguuuaaaaagggaaauggacuuauggacacuuucacaaacuccuacuccuuuugugagaauguaccaaaucuggauaaguuuguguuccagauggccagcgccacagaugaugcacagaaggacuccaucuaugcaucggcucuaguggaagcaaccaaguucugugcacccauauaugaaugugcuugggucagcucuacuggcauugugaagaaggggcuugagugguucgagaaggauucaggaacuaucaaaucaugggaugagaacuaugcugagcugaagguugauguucccaaaauagaacaacuugccaauuaccaacaggcugcucuuaaguggaggaaggacauagguuuccgugucaacgcaaacacggcagccuuaagcaacaaaguccuugcagaauacaaagucccuggugaaauugugaugucuguuaaagaaaugcugucagacaugauuagaaggaggaaucuaauucucaacaggggcggugaugaaaauccacgcggcccagugagccgugaacauguggaguggugcagggaauuugucaaaggcaaguacaucauggcuuucaauccaccuuggggggacaucaacaaaucaggucguucgggaauagcacuuguugcaacaggccuugccaagcuugcagagaccgaggggaaaggaguuuuugacgaagcuaagaagaccguggaggcucucaauggguauuuggacaagcacagggacgaagucgacaaagcaagugcugacagcaugauaacaaaccucccuaagcacauugccaaagcacaagagcuuuauaaaaauucaucugcucuucgugcacaaggugcacagauugacaccccuuucagcucguuuuacuggcucuacaaggccggugugacuccagagaccuucccaaccaucucacaguuccuuuuugaacugggggagcagccaagggggaccaaaaaaaugaaaaaggcacuccugagcacuccaaugaagugggggaagaaacuuuaugagcucuuugcugaugacucuuuccagcagaacagaaucuacaugcacccugcuguguugacagccgguagaaucagugaaaugggugucugcuuuggaacaaucccuguugccaauccugaugaugcugcucagggaucuggacauaccaaguccauucucaaccuucggacaagcacagagaccaacaauccaugcgccaagacaauugucaaauuauuugaaauccaagaaacaggauuuaacauacaggacauggacauuguggccucugagcacuugcugcaccaauccauuguuggcaagcaaucuccauuccaaaaugccuacaacgucaagggcaaugccaccagugccaacaucaucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16933 - RNA, 1666 nt, Artificial Sequence
  mRNA product Design1 comprising derived and/or modified sequence from CCHFV(Turkey-Kelkit06)__GQ337053.1__N (wt)
gggagaaagcuuaccauggaaaacaagaucgaggugaacagcaaggaugagaugaacaaaugguuugaggaguuuaaaaagggaaauggacuuauggacacuuucacaaacuccuacuccuuuugugagaauguaccaaaucuggauaaguuuguguuccagauggccagcgccacagaugaugcacagaaggacuccaucuaugcaucggcucuaguggaagcaaccaaguucugugcacccauauaugaaugugcuugggucagcucuacuggcauugugaagaaggggcuugagugguucgagaaggauucaggaacuaucaaaucaugggaugagaacuaugcugagcugaagguugauguucccaaaauagaacaacuugccaauuaccaacaggcugcucuuaaguggaggaaggacauagguuuccgugucaacgcaaacacggcagccuuaagcaacaaaguccuugcagaauacaaagucccuggugaaauugugaugucuguuaaagaaaugcugucagacaugauuagaaggaggaaucuaauucucaacaggggcggugaugaaaauccacgcggcccagugagccgugaacauguggaguggugcagggaauuugucaaaggcaaguacaucauggcuuucaauccaccuuggggggacaucaacaaaucaggucguucgggaauagcacuuguugcaacaggccuugccaagcuggcagagaccgaggggaaaggaguuuuugacgaagcuaagaagaccguggaggcucucaauggguauuuggacaagcacagggacgaagucgacaaagcaagugcugacagcaugauaacaaaccucccuaagcacauugccaaagcacaagagcuuuauaaaaauucaucugcucugcgugcacaaggugcacagauugacaccccuuucagcucguuuuacuggcucuacaaggccggugugacuccagagaccuucccaaccaucucacaguuccuuuuugaacugggggagcagccaagggggaccaaaaaaaugaaaaaggcacuccugagcacuccaaugaagugggggaagaaacuuuaugagcucuuugcugaugacucuuuccagcagaacagaaucuacaugcacccugcuguguugacagccgguagaaucagugaaaugggugucugcuuuggaacaaucccuguugccaauccugaugaugcugcucagggaucuggacauaccaaguccauucucaaccuucggacaagcacagagaccaacaauccaugcgccaagacaauugucaaauuauuugaaauccaagaaacaggauuuaacauacaggacauggacauuguggccucugagcacuugcugcaccaauccauuguuggcaagcaaucuccauuccaaaaugccuacaacgucaagggcaaugccaccagugccaacaucaucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16934 - RNA, 5272 nt, Artificial Sequence
  mRNA product Design1 comprising derived and/or modified sequence from CCHFV(10200)__U39455.2__GP (wt)
gggagaaagcuuaccaugcauauaucauuaauguaugcaauccuuugccuacagcuguguggucugggagagacucauggaucacacaaugaaacuagacacaauaaaacagacaccaugacaacacacggugauaacccgagcucugaaccgccagugagcacggccuugucuauuacacuugaccccuccacugucacacccacaacaccagccaguggauuagaaggcucaggggaagucuacacauccccuccgaucaccaccgggagcuugccccugucggagacaacaccagaacucccuguuacaaccggcacagacaccuuaagcgcaggugaugucgaucccagcacgcagacagccggaggcaccuccgcaccaacaguccgcacaagucuacccaacagcccuagcacaccaucuacaccacaagacacacaccauccugugagaaaucuacuuucagucacgaguccugggccagaugaaacaucaacacccucgggaacaggcaaagagagcucagcaaccaguagcccucauccagucuccaacagaccaccaaccccuccugcaacagcccagggacccacugaaaaugacagucacaacgccacugaacacccugagucccugacacagucagcaaccccaggccuaaugaccucuccaacacagauaguccacccacaaagugccacccccauaaccguucaagacacacaucccaguccaacgaacaggucuaaaagaaaccuuaagauggaaauaaucuugacuuuaucucaggguuuaaaaaaguacuaugggaaaauauuaaggcuucugcaacucaccuuagaggaggacacugaaggucuacuggaaugguguaagagaaaucuuggucuugauugugaugacacuuucuuucaaaagagaauugaagaauucuuuauaacuggugagggccauuuuaaugaaguuuuacaauuuagaacgccaggcacguugagcaccacagagucaacaccugcugggcugccaacagcugaaccuuuuaaguccuacuucgccaaaggcuuccucucgauagauucagguuacuacucagccaaauguuacucaggaacauccaauucagggcuucaauugauuaacauuacccgacauucaacuagaauaguugacacaccugggccuaagaucacuaaccuaaagaccaucaacugcauaaacuugaaggcaucgaucuucaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucaucccaggaacuuacaaaauagugauagauaaaaaaaauaaguugaaugacagaugcaccuuauuuaccgacugugugauaaaaggaagggagguucguaaaggacagucaguuuugaggcaguacaagacggaaaucaggauuggcaaggcaucaaccggcuuuagaagauugcuuucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16935 - RNA, 5272 nt, Artificial Sequence
  mRNA product Design1 comprising derived and/or modified sequence from CCHFV(10200)__U39455.2__GP (wt)
gggagaaagcuuaccaugcauauaucauuaauguaugcaauccuuugccuacagcuguguggucugggagagacucauggaucacacaaugaaacuagacacaauaaaacagacaccaugacaacacacggugauaacccgagcucugaaccgccagugagcacggccuugucuauuacacuugaccccuccacugucacacccacaacaccagccaguggauuagaaggcucaggggaagucuacacauccccuccgaucaccaccgggagcuugccccugucggagacaacaccagaacucccuguuacaaccggcacagacaccuuaagcgcaggagaugucgaucccagcacgcagacagccggaggcaccuccgcaccaacaguccgcacaagucuacccaacagcccuagcacaccaucuacaccacaagacacacaccauccugugagaaaucuacuuucagucacgaguccugggccagaugaaacaucaacacccucgggaacaggcaaagagagcucagcaaccaguagcccucauccagucuccaacagaccaccaaccccuccugcaacagcccagggacccacugaaaaugacagucacaacgccacugaacacccugagucccugacacagucagcaaccccaggccuaaugaccucuccaacacagauaguccacccacaaagugccacccccauaaccguucaagacacacaucccaguccaacgaacaggucuaaaagaaaccuuaagauggaaauaaucuugacuuuaucucaggguuuaaaaaaguacuaugggaaaauauuaaggcuucugcaacucaccuuagaggaggacacugaaggucuacuggaaugguguaagagaaaucuuggucuugauugugaugacacuuucuuucaaaagagaauugaagaguucuuuauaacuggugagggccauuuuaaugaaguuuuacaauuuagaacgccaggcacguugagcaccacagagucaaccccugcugggcugccaacagcugaaccuuuuaaguccuacuucgccaaaggcuuccucucgauagauucagguuacuacucagccaaauguuacucaggaacauccaauucagggcuucaauugauuaacauuacccgacauucaacuagaauaguugacacaccugggccuaagaucacuaaccuaaagaccaucaacugcauaaacuugaaggcaucgaucuucaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucaucccaggaacuuacaaaauagugauagauaaaaaaaauaaguugaaugacagaugcaccuuauuuaccgacugugugauaaaaggaagggagguucguaaaggacagucaguuuugaggcaguacaagacggaaaucaggauuggcaaggcaucaaccggcuuuagaagauugcuuucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16936 - RNA, 5272 nt, Artificial Sequence
  mRNA product Design1 comprising derived and/or modified sequence from CCHFV(IbAr10200)__AF467768.2__GP (wt)
gggagaaagcuuaccaugcauauaucauuaauguaugcaauccuuugccuacagcuguguggucugggagagacucauggaucacacaaugaaacuagacacaauaaaacagacaccaugacaacacccggugauaacccgagcucugaaccgccagugagcacggccuugucuauuacacuugaccccuccacugucacacccacaacaccagccaguggauuagaaggcucaggggaagucuacacauccccuccgaucaccaccgggagcuugccccugucggagacaacaccagaacucccuguuacaaccggcacagacaccuuaagcgcaggugaugucgaucccagcacgcagacagccggaggcaccuccgcaccaacaguccgcacaagucuacccaacagcccuagcacaccaucuacaccacaagacacacaccauccugugagaaaucuacuuucagucacgaguccugggccagaugaaacaucaacacccucgggaacaggcaaagagagcucagcaaccaguagcccucauccagucuccaacagaccaccaaccccuccugcaacagcccagggacccacugaaaaugacagucacaacgccacugaacacccugagucccugacacagucagcaaccccaggccuaaugaccucuccaacacagauaguccacccacaaagugccacccccauaaccguucaagacacacaucccaguccaacgaacaggucuaaaagaaaccuuaagauggaaauaaucuugacuuuaucucaggguuuaaaaaaguacuaugggaaaauauuaaggcuucugcaacucaccuuagaggaggacacugaaggucuacuggaaugguguaagagaaaucuuggucuugauugugaugacacuuucuuucaaaagagaauugaagaauucuuuauaacuggugagggccauuuuaaugaaguuuuacaauuuagaacgccaggcacguugagcaccacagagucaacaccugcugggcugccaacagcugaaccuuuuaaguccuacuucgccaaaggauuccucucgauagauucagguuacuacucagccaaauguuacucaggaacauccaauucagggcuucaauugauuaacauuacccgacauucaacuagaauaguugacacaccugggccuaagaucacuaaccuaaagaccaucaacugcauaaacuugaaggcaucgaucuucaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucaucccaggaacuuacaaaauagugauagauaaaaaaaauaaguugaaugacagaugcaccuuauuuaccgacugugugauaaaaggaagggagguucguaaaggacagucaguuuugaggcaguacaagacggaaaucaggauuggcaaggcaucaaccggcucuagaagauugcuuucagaagaacccagugaugacuguauaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggccauuuuuuacuuguuaauaauuguuggaacacuagggaaaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaaaaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacaggugggagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuggcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauagaagaauugccgaacuguucucuacaaaaacacacauuggcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16937 - RNA, 5272 nt, Artificial Sequence
  mRNA product Design1 comprising derived and/or modified sequence from CCHFV(IbAr10200)__AF467768.2__GP (wt)
gggagaaagcuuaccaugcauauaucauuaauguaugcaauccuuugccuacagcuguguggucugggagagacucauggaucacacaaugaaacuagacacaauaaaacagacaccaugacaacacccggugauaacccgagcucugaaccgccagugagcacggccuugucuauuacacuugaccccuccacugucacacccacaacaccagccaguggauuagaaggcucaggggaagucuacacauccccuccgaucaccaccgggagcuugccccugucggagacaacaccagaacucccuguuacaaccggcacagacaccuuaagcgcaggagaugucgaucccagcacgcagacagccggaggcaccuccgcaccaacaguccgcacaagucuacccaacagcccuagcacaccaucuacaccacaagacacacaccauccugugagaaaucuacuuucagucacgaguccugggccagaugaaacaucaacacccucgggaacaggcaaagagagcucagcaaccaguagcccucauccagucuccaacagaccaccaaccccuccugcaacagcccagggacccacugaaaaugacagucacaacgccacugaacacccugagucccugacacagucagcaaccccaggccuaaugaccucuccaacacagauaguccacccacaaagugccacccccauaaccguucaagacacacaucccaguccaacgaacaggucuaaaagaaaccuuaagauggaaauaaucuugacuuuaucucaggguuuaaaaaaguacuaugggaaaauauuaaggcuucugcaacucaccuuagaggaggacacugaaggucuacuggaaugguguaagagaaaucuuggucuugauugugaugacacuuucuuucaaaagagaauugaagaguucuuuauaacuggugagggccauuuuaaugaaguuuuacaauuuagaacgccaggcacguugagcaccacagagucaaccccugcugggcugccaacagcugaaccuuuuaaguccuacuucgccaaaggauuccucucgauagauucagguuacuacucagccaaauguuacucaggaacauccaauucagggcuucaauugauuaacauuacccgacauucaacuagaauaguugacacaccugggccuaagaucacuaaccuaaagaccaucaacugcauaaacuugaaggcaucgaucuucaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucaucccaggaacuuacaaaauagugauagauaaaaaaaauaaguugaaugacagaugcaccuuauuuaccgacugugugauaaaaggaagggagguucguaaaggacagucaguuuugaggcaguacaagacggaaaucaggauuggcaaggcaucaaccggcucuagaagauugcuuucagaagaacccagugaugacuguauaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggccauuuuuuacuuguuaauaauuguuggaacacuagggaaaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaaaaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacaggugggagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuggcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauagaagaauugccgaacuguucucuacaaaaacacacauuggcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16938 - RNA, 5284 nt, Artificial Sequence
  mRNA product Design1 comprising derived and/or modified sequence from CCHFV(Turkey-Kelkit06)__GQ337054.1__GP (wt)
gggagaaagcuuaccaugcccaccaacauuaugcauacaccauuagugugcuucauucuuuaccuacagcuguugugucuaggaggagcucaugggcaguuaaacgcaacugaacacaauggaacaaacaacaccacagcaccuggcgcaagccaaagccccaagccacccaugagcacaaccccaccacacgcaccggaaucauccaccaucaaacccaccacaccaauaagcgaagcagaaggcucaggggaaacgaccucacccccaaacaccacccagggccuguccucgccagagaccacaucagaacgcccugcaacaaccuccaucagcacgucaagcacagacagcacgaaccccaccacacagaugaccgacaacacccccacaccaacagucagcacaagcccauccagcagccccagcacgccauccacaccacaaggcauacaucauccugcaaggagucuguugucagucucgagccccaagacaguaacaacaccaacaccaacgagcccuggagagaugagcucggaaaccagcagucagcacucagccaugagcagaauaccaaccccccacacagcaacccgggucuccacugagaucaccaaccaccgcacaccuagacaaucugaauccucagcacagcagacaaccccaagcccaaugacuuccccagcgcaaucgauccuucuaaugagugcugcuccuacagcuguucaagacauacaucccagcccaacaaacaggucuaagaggaaccuugagacggaaauaauuuuaacucuaucucaaggucuaaagaaauacuacgguaagauacugaagcuucugcaccucaccuuagaacaggacaccgaaggccugcuagaaugguguaagggaaaccuugggucaaacugugaugaugacuucuuucaaaagagaauagaagaauucuucaugacuggugagugcuacuucaaugaagucuuacaauuuaaaacacuaagcacacuaagccccacggagccgucucaugccaggcuaccaacagcagaacccuucaaaucuuacuuugcuaagggcuuccuuucaauagauucagguuacuucucugccaaauguuauccaagaucaucugcuucagggcuucagcugaucaauguuacccaacacccagcuaggauagcagaaacaccuggacccaagacaacaagucugaaaaccaucaacuguauaaaccuaagagcaucagucuucaaagaacacagagaaguugagaucaaugugcuucuuccucagauugcagucaaccucucaaacugccauguugugaucaauucacaugucugugauuacucuuuagacacugaugggccagugaggcuuccucgcauuuaucaugaagggacuuucauaccaggaacuuauaaaauagugauagacaaaaaaaauaagcuaaaugaccguuguacacuggucaccaacugugugauaaagggaagagagguucguaaggggcaaucagugcugaggcaguacaaaacagaaaucaagauaggcaaggcaucaacaggcuuuaggaaacuacuguccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcaaaaacagcgccacagggaaaaccugugagguagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggggauauccuaguggacuguucaggugggcagcaacauuucuuaaaagacaacuuaauugaccuagggugcccccauaucccgcuauuggguaggauggcuauuuacauuugcagaaugucaaaucauccuagaacaaccauggcuuuucucuucugguucagcuuuggcuauguuaucacuuguauauuuugcaaggcucuuuuuuauucauugauaauuauuggaacacuaggaaaaaagaucaagcaauauagggaacugaaaccucaaaccugcaccauaugugagacagcuccugucaaugcaauagaugcugaaaugcaugaccucaacuguaguuacaauauaugcccuuauugugcaucaagauugaccuccgaugggcuagccaggcauguaacgcaaugccccaagcggaaagagaaaguugaggagacugaacuguaccugaaccuggaaagaauuccuuggauugucagaaagcuauugcaggugucagaguccacugguguggcauugaaacgaagcagcuggcugauuguacugcuuguguuacugacaguuucguugucgccgguucagucagcaccuguuggucauggaaagacaaucgaaauauaucagaccagggaaggauucgcaagcaucugucucuuuauguuaggaagcauucuauuuauagucucuugcuuggugaaagggcuaguugacagugucagugaaagcuucuuccccggccuaucugucuguaagacaugcucuauuggcaguguaaauggcuuugaaauugaaucgcacaaaugcuacuguagccuauuuugcugccccuacuguaggcacugcucugcugacagagaaauucaccaguuacacuugaguaucugcaaaaaaaggaaaacggggagcaaugucaugcuggccgucugcaaacgcaugugcuuuagggcaaccauagaagcaagcagaagagcccugcucauccgaagcauuaucaauaccacuuuuguaauaugcauucuaacauugacaaucuguguuguuagcaccucugcaguggagauggaaaaccuuccagcaggaacuugggagagggaggaagaucugacaaauuucugucaucaggaaugccaggugacugagacagaaugccucuguccauacgaagcucuugugcucagaaaaccucuuuucuuggacaguauaguuaaagguaugaaaaauuugcuaaacucaacaagcuuggaaacaagcuuaucaauugaggcaccauggggagcaauaaauguccaaucaaccuuuaaaccaacuguaucgacugcaaacauagcacucaguuggagcucaguggugcacagaggcaacaagaucuuggucacaggcaggucugaaucaauuaugaaacuggaggaaaggacaggagucagcugggaucuaggcguagaagaugccucugaauccaaauuacuuaccguuucuaucauggauuugucacaaauguauucuccuguuuuugaguacuugucaggagacagacagguugaagaauggcccaaagcaacuuguacaggugauugcccggaaaggugugguugcacaucaucaaccugcuuacauaaagaauggucucacucaagaaacuggagauguaaucccacuuggugcuggggaguaggaaccggcugcaccugcugcgggguggauguaaaagaucuuuuuaccgaucacauguuugucaaauggaaaguugaauacauaaaaacugaagcuauaguauguguugcgcucaccagccaagaaagacagugcagucugauugaggcagguacuagauucaacuugggcccugugacuauuacccugucugagccaagaaacauucagcagaagcuuccuccugagauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaucacauuucaacaccucuuggauguccugggaugguugugacuuagacuacuacugcaacaugggggauuggccaucuugcacauacacaggagugacccagcauaaccaugcugcauuuguaaacuugcuuaacauugaaacugauuacacgaaaaccuuccacuuccacucuaaaagagucacagcacauggugacacaccacaauuggacuuaaaagcaaggccgaccuacggugcaggugggaucacugugcugguugagguugcugacauggaguugcauaccaagaaaguugaaauaucaggcuugaaauuugcaagucuggcuugcacggguugcuaugcuuguagcucuggcaucuccuguaaaguuaggauucauguagaugaaccagaugagcucacaguacauguaaagagcagugauccagaugugguugcagcuagcacaagucucauggcgaggaagcuugaauuugggacagacagcacauucaaggccuuuucagcuaugcccaaaaccucucuauguuuuuacauuguggagagagaauacugcaagagcugcagugaagaugauacacaaaaauguguugacacaagacuugagcagccacagagcauacuaauugagcacaaaggaacgauaauuggaaagcagaaugauacuugcacagccaaggcaagcuguuggcuagagucagucaagaguuuuuuuuauggauugaagaauaugcuuggcaguguuuuugguaaucuuuucauaggcauuuuguuauuccuugccccuuuuguccuguuggugcuuuucuuuauguuuggguggaaaaucuuguuuugcuuuaaauguugcaggaggaccagaggcuuauuuaaguauagacaccucaaagacgaugaggaaacaggcuacagaaggauuauugaaagacugaacagcaaaaaagggaaaaacaggcugcuugauggugauagacuggcugauaggaaaauugcugagcuguucuccacaaaaacacacauuggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16939 - RNA, 5284 nt, Artificial Sequence
  mRNA product Design1 comprising derived and/or modified sequence from CCHFV(Turkey-Kelkit06)__GQ337054.1__GP (wt)
gggagaaagcuuaccaugcccaccaacauuaugcauacaccauuagugugcuucauucuuuaccuacagcuguugugucuaggaggagcucaugggcaguuaaacgcaacugaacacaauggaacaaacaacaccacagcaccuggcgcaagccaaagccccaagccacccaugagcacaaccccaccacacgcaccggaaucauccaccaucaaacccaccacaccaauaagcgaagcagaaggcucaggggaaacgaccucacccccaaacaccacccagggccuguccucgccagagaccacaucagaacgcccugcaacaaccuccaucagcacgucaagcacagacagcacgaaccccaccacacagaugaccgacaacacccccacaccaacagucagcacaagcccauccagcagccccagcacgccauccacaccacaaggcauacaucauccugcaaggagucuguugucagucucgagccccaagacaguaacaacaccaacaccaacgagcccuggagagaugagcucggaaaccagcagucagcacucagccaugagcagaauaccaaccccccacacagcaacccgggucuccacugagaucaccaaccaccgcacaccuagacaaucugaauccucagcacagcagacaaccccaagcccaaugacuuccccagcgcaaucgauccuucuaaugagugcugcuccuacagcuguucaagacauacaucccagcccaacaaacaggucuaagaggaaccuugagacggaaauaauuuuaacucuaucucaaggucuaaagaaauacuacgguaagauacugaagcugcugcaccucaccuuagaacaggacaccgaaggccugcuagaaugguguaagggaaaccuugggucaaacugugaugaugacuucuuucaaaagagaauagaagaguucuucaugacuggugagugcuacuucaaugaagucuuacaauuuaaaacacuaagcacacuaagccccacggagccgucucaugccaggcuaccaacagcagaacccuucaaaucuuacuuugcuaagggcuuccuuucaauagauucagguuacuucucugccaaauguuauccaagaucaucugcuucagggcuucagcugaucaauguuacccaacacccagcuaggauagcagaaacaccuggacccaagacaacaagucugaaaaccaucaacuguauaaaccuaagagcaucagucuucaaagaacacagagaaguugagaucaaugugcuucuuccucagauugcagucaaccucucaaacugccauguugugaucaauucacaugucugugauuacucuuuagacacugaugggccagugaggcuuccucgcauuuaucaugaagggacuuucauaccaggaacuuauaaaauagugauagacaaaaaaaauaagcuaaaugaccguuguacacuggucaccaacugugugauaaagggaagagagguucguaaggggcaaucagugcugaggcaguacaaaacagaaaucaagauaggcaaggcaucaacaggcuuuaggaaacuacuguccgaagaaccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcaaaaacagcgccacagggaaaaccugugagguagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggggauauccuaguggacuguucaggugggcagcaacauuucuuaaaagacaacuuaauugaccuagggugcccccauaucccgcuauuggguaggauggcuauuuacauuugcagaaugucaaaucauccuagaacaaccauggcuuuucucuucugguucagcuuuggcuauguuaucacuuguauauuuugcaaggcucuuuuuuauucauugauaauuauuggaacacuaggaaaaaagaucaagcaauauagggaacugaaaccucaaaccugcaccauaugugagacagcuccugucaaugcaauagaugcugaaaugcaugaccucaacuguaguuacaauauaugcccuuauugugcaucaagauugaccuccgaugggcuagccaggcauguaacgcaaugccccaagcggaaagagaaaguugaggagacugaacuguaccugaaccuggaaagaaucccuuggauugucagaaagcuauugcaggucucagaguccacugguguggcauugaaacgaagcagcuggcugauuguacugcuuguguuacugacaguuucguugucgccgguucagucagcaccuguuggucauggaaagacaaucgaaauauaucagaccagggaaggauucgcaagcaucugucucuuuauguuaggaagcauucuauuuauagucucuugcuuggugaaagggcuaguugacagugucagugagagcuucuuccccggccuaucugucuguaagacaugcucuauuggcaguguaaauggcuuugaaauugaaucgcacaaaugcuacuguagccuauuuugcugccccuacuguaggcacugcucugcugacagagaaauucaccaguuacacuugaguaucugcaaaaaaaggaaaacggggagcaaugucaugcuggccgucugcaaacgcaugugcuuuagggcaaccauagaagcaagcagaagggcccugcucauccgaagcauuaucaauaccacuuuuguaauaugcauucuaacauugacaaucuguguuguuagcaccucugcaguggagauggaaaaccuuccagcaggaacuugggagagggaggaagaucugacaaauuucugucaucaggaaugccaggugacugagacagaaugccucuguccauacgaagcucuugugcucagaaaaccucuuuucuuggacaguauaguuaaagguaugaaaaauuugcuaaacucaaccagcuuggaaaccagcuuaucaauugaggcaccauggggagcaauaaauguccaaucaaccuuuaaaccaacuguaucgacugcaaacauagcacucaguuggagcucaguggugcacagaggcaacaagaucuuggucacaggcaggucugaaucaauuaugaaacuggaggaaaggacaggagucagcugggaucuaggcguagaagaugccucugaauccaaauuacuuaccguuucuaucauggauuugucacaaauguauucuccuguuuuugaguacuugucaggagacagacagguugaagaauggcccaaagcaacuuguacaggugauugcccggaaaggugugguugcacaucaucaaccugcuuacauaaagaauggucucacucaagaaacuggagauguaaucccacuuggugcuggggaguaggaaccggcugcaccuguugcgggguggauguaaaagaucuuuuuaccgaucacauguuugucaaauggaaaguugaauacauaaaaacugaagcuauaguauguguugcgcucaccagccaagaaagacagugcagucugauugaggcagguacuagauucaacuugggcccugugacuauuacccugucugagccaagaaacauucagcagaagcugccuccugagauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaucacauuucaacaccucuuggauguccugggaugguugugacuuagacuacuacugcaacaugggggauuggccaucuugcacauacacaggagugacccagcauaaccaugcugcauuuguaaacuugcuuaacauugaaacugauuacacgaaaaccuuccacuuccacucuaaaagagucacagcacauggugacacaccacaauuggacuuaaaagcaaggccgaccuacggugcaggagggaucacugugcugguugagguugcugacauggaguugcauaccaagaaaguugaaauaucaggcuugaaauuugcaagucuggcuugcacggguugcuaugcuuguagcucuggcaucuccuguaaaguuaggauucauguagaugaaccagaugagcucacaguacauguaaagagcagugauccagaugugguugcagcuagcacaagucucauggcgaggaagcuggaauuugggacagacagcacauucaaggccuuuucagcuaugcccaaaaccucucuauguuuuuacauuguggagagagaauacugcaagagcugcagugaagaugauacacaaaaauguguugacacaagacuugagcagccacagagcauacuaauugagcacaaaggaacgauaauuggaaagcagaaugauacuugcacagccaaggcaagcuguuggcuagagucagucaagaguuuuuuuuauggauugaagaauaugcuuggcaguguuuuugguaaucuuuucauaggcauuuuguuauuccuugccccuuuuguccuguuggugcuuuucuuuauguuuggguggaaaaucuuguuuugcuuuaaauguugcaggaggaccagaggcuuauuuaaguauagacaccucaaagacgaugaggaaacaggcuacagaaggauuauugaaagacugaacagcaaaaaagggaaaaacaggcugcuugauggugauagacuggcugauaggaaaauugcugagcuguucuccacaaaaacacacauuggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16940 - RNA, 3796 nt, Artificial Sequence
  mRNA product Design1 comprising derived and/or modified sequence from CCHVF(10200)__U39455.2__SP-GP_Gn-NSm-Gc (wt)
gggagaaagcuuaccaugcauauaucauuaauguaugcaauccuuugccuacagcuguguggucugggagagacucauggaucacacaaugaaacuucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16941 - RNA, 3796 nt, Artificial Sequence
  mRNA product Design1 comprising derived and/or modified sequence from CCHVF(10200)__U39455.2__SP-GP_Gn-NSm-Gc (wt)
gggagaaagcuuaccaugcauauaucauuaauguaugcaauccuuugccuacagcuguguggucugggagagacucauggaucacacaaugaaacuucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16942 - RNA, 3769 nt, Artificial Sequence
  mRNA product Design1 comprising derived and/or modified sequence from CCHVF(10200)__U39455.2__IgE-leader_Gn-NSm-Gc (wt)
gggagaaagcuuaccauggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16943 - RNA, 3769 nt, Artificial Sequence
  mRNA product Design1 comprising derived and/or modified sequence from CCHVF(10200)__U39455.2__IgE-leader_Gn-NSm-Gc (wt)
gggagaaagcuuaccauggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16944 - RNA, 3190 nt, Artificial Sequence
  mRNA product Design1 comprising derived and/or modified sequence from CCHVF(10200)__U39455.2__IgE-leader_Gn-4aa-Gc (wt)
gggagaaagcuuaccauggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauugguagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16945 - RNA, 3190 nt, Artificial Sequence
  mRNA product Design1 comprising derived and/or modified sequence from CCHVF(10200)__U39455.2__IgE-leader_Gn-4aa-Gc (wt)
gggagaaagcuuaccauggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauugguagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16946 - RNA, 1246 nt, Artificial Sequence
  mRNA product Design1 comprising derived and/or modified sequence from CCHVF(10200)__U39455.2__IgE-leader_Gn (wt)
gggagaaagcuuaccauggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauugguuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16947 - RNA, 1246 nt, Artificial Sequence
  mRNA product Design1 comprising derived and/or modified sequence from CCHVF(10200)__U39455.2__IgE-leader_Gn (wt)
gggagaaagcuuaccauggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauugguuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16948 - RNA, 2206 nt, Artificial Sequence
  mRNA product Design1 comprising derived and/or modified sequence from CCHVF(10200)__U39455.2__IgE-leader_Gc (wt)
gggagaaagcuuaccauggacuggaccuggauccuguuccucguggccgccgcgacccgcguccacagcuuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16949 - RNA, 2206 nt, Artificial Sequence
  mRNA product Design1 comprising derived and/or modified sequence from CCHVF(10200)__U39455.2__IgE-leader_Gc (wt)
gggagaaagcuuaccauggacuggaccuggauccuguuccucguggccgccgcgacccgcguccacagcuuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16950 - RNA, 1666 nt, Artificial Sequence
  mRNA product Design1 comprising derived and/or modified sequence from CCHFV(10200)__NC_005302.1/U88410.1__N (opt4)
gggagaaagcuuaccauggagaacaagaucgaggugaacaacaaggacgagaugaacagaugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggacgugcccaagaucgagcagcugaccggcuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagccacgagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcaucuucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagagcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgaggugcagaagaccggcuucaacauccaggacauggacaucguggccagcgagcaucugcugcaccagagccuggugggcaagcagagccccuuccagaacgccuacaacgugaagggcaacgccaccagcgccaacaucaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16951 - RNA, 1666 nt, Artificial Sequence
  mRNA product Design1 comprising derived and/or modified sequence from CCHFV(Turkey-Kelkit06)__GQ337053.1__N (opt4)
gggagaaagcuuaccauggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaaggacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcccaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcgagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccaggagaccggcuucaacauccaggacauggacaucguggccagcgagcaucugcugcaccagagcaucgugggcaagcagagccccuuccagaacgccuacaacgugaagggcaacgccaccagcgccaacaucaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16952 - RNA, 5272 nt, Artificial Sequence
  mRNA product Design1 comprising derived and/or modified sequence from CCHFV(10200)__U39455.2__GP (opt4)
gggagaaagcuuaccaugcacaucagccugauguacgccauccugugccugcagcugugcggccugggcgagacccacggcagccacaacgagaccagacacaacaagaccgacaccaugaccacccacggcgacaaccccagcagcgagccccccgugagcaccgcccugagcaucacccuggaccccagcaccgugacccccaccacccccgccagcggccuggagggcagcggcgagguguacaccagcccccccaucaccaccggcagccugccccugagcgagaccacccccgagcugcccgugaccaccggcaccgacacccugagcgccggcgacguggaccccagcacccagaccgccggcggcaccagcgcccccaccgugagaaccagccugcccaacagccccagcacccccagcaccccccaggacacccaccaccccgugagaaaccugcugagcgugaccagccccggccccgacgagaccagcacccccagcggcaccggcaaggagagcagcgccaccagcagcccccaccccgugagcaacagaccccccaccccccccgccaccgcccagggccccaccgagaacgacagccacaacgccaccgagcaccccgagagccugacccagagcgccacccccggccugaugaccagccccacccagaucgugcacccccagagcgccacccccaucaccgugcaggacacccaccccagccccaccaacagaagcaagagaaaccugaagauggagaucauccugacccugagccagggccugaagaaguacuacggcaagauccugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccccgccggccugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacagccuggacaucgacggcgccgugagacugccccacaucuaccacgagggcguguucauccccggcaccuacaagaucgugaucgacaagaagaacaagcugaacgacagaugcacccuguucaccgacugcgugaucaagggcagagaggugagaaagggccagagcgugcugagacaguacaagaccgagaucagaaucggcaaggccagcaccggcuucagaagacugcugagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16953 - RNA, 5272 nt, Artificial Sequence
  mRNA product Design1 comprising derived and/or modified sequence from CCHFV(IbAr10200)__AF467768.2__GP (opt4)
gggagaaagcuuaccaugcacaucagccugauguacgccauccugugccugcagcugugcggccugggcgagacccacggcagccacaacgagaccagacacaacaagaccgacaccaugaccacccccggcgacaaccccagcagcgagccccccgugagcaccgcccugagcaucacccuggaccccagcaccgugacccccaccacccccgccagcggccuggagggcagcggcgagguguacaccagcccccccaucaccaccggcagccugccccugagcgagaccacccccgagcugcccgugaccaccggcaccgacacccugagcgccggcgacguggaccccagcacccagaccgccggcggcaccagcgcccccaccgugagaaccagccugcccaacagccccagcacccccagcaccccccaggacacccaccaccccgugagaaaccugcugagcgugaccagccccggccccgacgagaccagcacccccagcggcaccggcaaggagagcagcgccaccagcagcccccaccccgugagcaacagaccccccaccccccccgccaccgcccagggccccaccgagaacgacagccacaacgccaccgagcaccccgagagccugacccagagcgccacccccggccugaugaccagccccacccagaucgugcacccccagagcgccacccccaucaccgugcaggacacccaccccagccccaccaacagaagcaagagaaaccugaagauggagaucauccugacccugagccagggccugaagaaguacuacggcaagauccugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccccgccggccugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacagccuggacaucgacggcgccgugagacugccccacaucuaccacgagggcguguucauccccggcaccuacaagaucgugaucgacaagaagaacaagcugaacgacagaugcacccuguucaccgacugcgugaucaagggcagagaggugagaaagggccagagcgugcugagacaguacaagaccgagaucagaaucggcaaggccagcaccggcagcagaagacugcugagcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaagggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacaggugggcgaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcggcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacagaagaaucgccgagcuguucagcaccaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16954 - RNA, 5284 nt, Artificial Sequence
  mRNA product Design1 comprising derived and/or modified sequence from CCHFV(Turkey-Kelkit06)__GQ337054.1__GP (opt4)
gggagaaagcuuaccaugcccaccaacaucaugcacaccccccuggugugcuucauccuguaccugcagcugcugugccugggcggcgcccacggccagcugaacgccaccgagcacaacggcaccaacaacaccaccgcccccggcgccagccagagccccaagccccccaugagcaccacccccccccacgcccccgagagcagcaccaucaagcccaccacccccaucagcgaggccgagggcagcggcgagaccaccagcccccccaacaccacccagggccugagcagccccgagaccaccagcgagagacccgccaccaccagcaucagcaccagcagcaccgacagcaccaaccccaccacccagaugaccgacaacacccccacccccaccgugagcaccagccccagcagcagccccagcacccccagcaccccccagggcauccaccaccccgccagaagccugcugagcgugagcagccccaagaccgugaccacccccacccccaccagccccggcgagaugagcagcgagaccagcagccagcacagcgccaugagcagaauccccaccccccacaccgccaccagagugagcaccgagaucaccaaccacagaacccccagacagagcgagagcagcgcccagcagaccacccccagccccaugaccagccccgcccagagcauccugcugaugagcgccgcccccaccgccgugcaggacauccaccccagccccaccaacagaagcaagagaaaccuggagaccgagaucauccugacccugagccagggccugaagaaguacuacggcaagauccugaagcugcugcaccugacccuggagcaggacaccgagggccugcuggaguggugcaagggcaaccugggcagcaacugcgacgacgacuucuuccagaagagaaucgaggaguucuucaugaccggcgagugcuacuucaacgaggugcugcaguucaagacccugagcacccugagccccaccgagcccagccacgccagacugcccaccgccgagcccuucaagagcuacuucgccaagggcuuccugagcaucgacagcggcuacuucagcgccaagugcuaccccagaagcagcgccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcuucagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagaguuucaagcugugcaagaacagcgccaccggcaagaccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcagaauggccaucuacaucugcagaaugagcaaccaccccagaaccaccauggccuuccuguucugguucagcuucggcuacgugaucaccuguaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggucagcgagagcaccggcguggcccugaagagaagcagcuggcugaucgugcugcuggugcugcugaccgugagccugagccccgugcagagcgcccccgugggccacggcaagaccaucgagaucuaccagaccagagagggcuucgccagcaucugccuguucaugcugggcagcauccuguucaucgugagcugccuggugaagggccugguggacagcgugagcgagagcuucuuccccggccugagcgugugcaagaccugcagcaucggcagcgugaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagggcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggugcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccuguaccggcgacugccccgagagaugcggcugcaccagcagcaccugucugcacaaggaguggagccacagcagaaacuggagaugcaaccccaccuggugcuggggcgugggcaccggcugcaccuguugcggcguggacgugaaggaccuguucaccgaccacauguucgugaaguggaagguggaguacaucaagaccgaggccaucgugugcguggcccugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcaggucuaccacaucggcaaccugcugaagggcgacagagugaacggccaccugauccacaagaucgagagccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcggcaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagaguagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccagacuggagcagccccagagcauccugaucgagcacaagggcaccaucaucggcaagcagaacgacaccuguaccgccaaggccagcugcuggcuggagagcgugaagaguuucuucuacggccugaagaacaugcugggcagcguguucggcaaccuguucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgacagacuggccgacagaaagaucgccgagcuguucagcaccaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16955 - RNA, 3796 nt, Artificial Sequence
  mRNA product Design1 comprising derived and/or modified sequence from CCHVF(10200)__U39455.2__SP-GP_Gn-NSm-Gc (opt4)
gggagaaagcuuaccaugcacaucagccugauguacgccauccugugccugcagcugugcggccugggcgagacccacggcagccacaacgagaccagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16956 - RNA, 3769 nt, Artificial Sequence
  mRNA product Design1 comprising derived and/or modified sequence from CCHVF(10200)__U39455.2__IgE-leader_Gn-NSm-Gc (opt4)
gggagaaagcuuaccauggacuggaccuggauccuguuccugguggccgccgccaccagagugcacagcagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16957 - RNA, 3190 nt, Artificial Sequence
  mRNA product Design1 comprising derived and/or modified sequence from CCHVF(10200)__U39455.2__IgE-leader_Gn-4aa-Gc (opt4)
gggagaaagcuuaccauggacuggaccuggauccuguuccugguggccgccgccaccagagugcacagcagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggcagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16958 - RNA, 1246 nt, Artificial Sequence
  mRNA product Design1 comprising derived and/or modified sequence from CCHVF(10200)__U39455.2__IgE-leader_Gn (opt4)
gggagaaagcuuaccauggacuggaccuggauccuguuccugguggccgccgccaccagagugcacagcagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16959 - RNA, 2206 nt, Artificial Sequence
  mRNA product Design1 comprising derived and/or modified sequence from CCHVF(10200)__U39455.2__IgE-leader_Gc (opt4)
gggagaaagcuuaccauggacuggaccuggauccuguuccugguggccgccgccaccagagugcacagcuuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16960 - RNA, 1666 nt, Artificial Sequence
  mRNA product Design1 comprising derived and/or modified sequence from CCHFV(10200)__NC_005302.1/U88410.1__N (opt3)
gggagaaagcuuaccauggagaacaagaucgaagugaauaacaaagacgagaugaauagaugguucgaagaguuuaagaaaggcaacgggcuggucgauaccuucacaaauagcuacuccuuuugcgaaucuguucccaaccucgacagguucguguuucagauggccucagcuacugaugacgcacaaaaggauaguauuuaugccagcgcgcuuguagaggcuacgaaauucugugccccuauauacgagugcgcauggguguccucuaccggaaucgucaagaagggucuggaaugguuugagaaaaaugccggcacaauuaagucgugggacgaaucauauacugaguugaaaguggauguuccaaagaucgagcaguuaaccggguaccagcaggcugcacugaaauggcggaaggacauuggauuccgcgugaacgccaauacagcugcccuaagcaacaagguccucgcggaauauaaagugccgggcgagaucguaaugaguguuaaggaaaugcuguccgauaugauacgacguagaaaucuuauccugaacagggguggggacgagaauccccggggaccugugucucacgaacaugucgauuggugucgcgaguuugugaaaggcaaguacauuauggcauucaacccacccuggggcgacaucaauaaaagcgggagauccggaauugccuugguggcuaccggucucgccaagcuggcagagacugaaggcaaagggaucuuugaugaggcuaagaagacagucgaagcccugaacggauaucucgacaaacacaaggacgagguugauagggcgucagccgacaguaugauaaccaacuuacugaaacauauugcaaaggcucaagaacuuuacaaaaauagcucugccuugcgggcucaguccgcccagaucgauacggcauucucaagcuacuauuggcuguacaaggccggcgugacuccugagaccuuuccaacaguaagucaguuccuauucgagcucgguaagcaaccccgcgggacuaaaaagaugaaaaaggcucugcuuucuaccccuaugaaauggggaaagaagcuguaugaauuguuugcggacgauuccuuccagcagaaccgaauuuacaugcacccagcagugcucacagccggcagaaucagcgagaugggcgucugcuuugggaccaucccgguggcuaaucccgacgaugccgcacagggaucgggucauacgaaaucuauucugaacuuaaggacuaauacagaaaccaacaauccuugugccaagacuauaguuaaacuguucgaggugcaaaagacaggcuuuaacauccaggacauggauauugucgcuuccgaacaccuccuucaccagucacugguggggaaacaaaguccauuccagaaugccuauaacguaaagggaaaugcaaccagcgcgaacaucauaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16961 - RNA, 1666 nt, Artificial Sequence
  mRNA product Design1 comprising derived and/or modified sequence from CCHFV(Turkey-Kelkit06)__GQ337053.1__N (opt3)
gggagaaagcuuaccauggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaagacucgggcacaauuaagucaugggaugaaaauuaugccgaguugaaagucgacgugccaaagaucgagcaguuagcuaacuaccagcaggcagcccugaaguggagaaaagauauuggguucaggguuaaugcuaacacugccgcgcuaagcaauaaggugcucgcagaauauaaagucccgggagagaucgugaugaguguaaaggaaaugcuguccgacaugauacggcgccgaaaccuuauccugaaucguggcggugaugagaaccccagagggccuguuucuagggaacacguggaguggugucgggaguuugucaaaggaaaguacauuauggccuucaauccacccuggggcgacaucaacaaaagcggccgcuccgggauugcuuugguggccaccggacucgcaaagcuggcugaaacagaggguaagggcguguuugaugaagccaaaaagaccgucgaggcgcugaacggguaucucgacaaacauagagacgaaguugauaaggccucagcagacaguaugaucacuaauuuaccuaaacacauagcuaaggcccaagagcuguacaagaacagcucugcucuuagggcccagggagcacagauugauacaccauucuccucauuuuacugguuguauaaagccggcgugacccccgagacguucccuacuaucagccaguuccuguuugaacuaggugagcaaccacgggggaccaagaaaaugaagaaagcucuccugaguacaccgaugaaguggggaaagaaacuuuacgaacuguucgcggacgauucuuuucagcagaaucgcauuuauaugcaucccgcaguauugacugccggccgaaucuccgagaugggcgugugcuucgggaccaucccugucgcuaacccagacgaugccgcacagggaagcggucacacaaagucgauucucaaucugagaaccucuacggaaacuaacaaucccugugccaaaacaauagugaaguuauuugagauccaagagaccggcuucaacauucaggacauggauaucguugcuuccgaacaucugcuccaccagucaauaguggggaaacaaaguccuuuucagaaugccuacaacgucaagggaaaugcaacuagcgcgaacauuaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16962 - RNA, 5272 nt, Artificial Sequence
  mRNA product Design1 comprising derived and/or modified sequence from CCHFV(10200)__U39455.2__GP (opt3)
gggagaaagcuuaccaugcacaucagccugauguacgccauucucugccuucagcuguguggcuugggggagacccauggaucccacaacgaaacaagacauaauaagacugacacgaugaccacacacggugauaaccccucuucagagccuccagugaguacugcuuuaagcauaacccuggacccguccacagucacccccacuacuccugcaucuggccuagaagggucgggagagguuuauaccucaccacccaucacgacuggcagccucccucugagugaaaccacaccagagcuucccgugacuaccgguacagauacccuguccgccggggacguagauccuucuacgcagacugcgggaggcacaagcgcuccaaccgugaggacuuccuugcccaauucacccaguacaccuagcaccccacaggacacgcaucaccccguccggaaccuccugucugugaccuccccuggcccagaugagacaucaacucccagcgggaccggaaaagaaaguucugccacauccagcccgcacccuguuucgaaucgcccgccaacuccucccgcaaccgcccaggguccaacagagaacgacucucauaaugcuaccgaacaccccgagucccugacucagucagcaacgccuggccucaugacaaguccaacccaaauugugcauccgcagagcgccacucccaucaccguccaggauacacacccuuccccaaccaaccgaucuaagcguaauuuaaaaauggagauuauccugacucuuagccagggguugaagaaauacuauggaaagauacugagacuacuccaacugacacuugaagaggacacggaaggccuguuggaguggugcaagaggaaccucggucuggauugugacgauaccuucuuucagaaacggaucgaagaguucuuuauuacuggggagggacacuucaaugaaguguuacaguuucgcacacccggcacccugucaacaacugagaguaccccugcuggccucccaacggccgaacccuucaaguccuacuuugcgaaaggguuccuuagcaucgacucuggauauuacucagcaaagugcuauagugguaccagcaacuccggccugcaguugauuaauaucacaagacauucuacuaggauaguagacaccccggggccuaaaauuacaaaccuaaagacuaucaauuguauuaaccugaaggccucgaucuuuaaagagcaccgggaaguugagaucaacgugcuccugccacaagucgcugugaaucuuagcaacugccauguggucauuaagucccacguuugugauuacucacuggacauagauggagccgugcgcuugccccauaucuaccacgagggcguauucauuccugguaccuauaaaaucgugauagacaagaaaaauaagcucaacgaucgaugcacgcuguuuacagacugugucauuaaagggagagaagugaggaagggccagaguguuuuacggcaguacaagaccgagauccguaucggaaaagcaucuacuggcuuccgcagacugcuaagcgaggaacccuccgaugacugcgugucaaggacacaacuccugcggaccgaaacugcugagauucacggggauaauuauggagguccaggcgacaagaucaccauuuguaacgggagcacaauagucgaucagcgacuuggaucugaguugggcugcuacacgaucaaucgcgugagauccuuuaaacugugcgaaaacagugccaccgguaagaauugugagauugacagcguaccuguuaaaugcaggcagggguauugucuccggaucacucaggaaggccgcggacaugugaagcugucuagaggcuccgaggucgugcuugacgcgugcgauacaucaugugagaucaugauucccaaggggaccggagacauacuggucgauugcagugguggccaacagcacuucuugaaagacaaccucaucgaucugggguguccaaagauuccguuacugggaaaaauggccaucuacauuugcaggaugagcaaucauccuaagacaacuauggcauuccuauuuugguucucguuuggcuaugugaucaccuguauacucugcaaagcuaucuucuaccugcuuauuaucguugguacguuggggcgucggcugaagcaguaccgagaacucaagccccagacauguaccauuugcgagacuaccccagugaacgccaucgacgcugaaaugcacgaucugaauugcuccuauaacauaugucccuacugcgccucuagauuaacaagcgacggccuggcaaggcacguaauucaauguccuaaacgcaaggagaaagucgaagagacugagcuuuauuugaaucucgaacggaucccaugggugguuagaaagcugcuacaggugucagagaguaccggagucgcccugaaaagguccucuuggcucauugugcugcuuguauuguuuacagugagccugucccccguucagucagcuccuaucggccaggggaagacgauagaagcguaccgcgcacgagagggauauaccagcaucugcuuauucguccucggcaguauucuguuuaucgugucuugucuuaugaagggucugguggauuccgucgggaacagcuucuuuccgggauugucgauuugcaaaacuuguucaaucucuaguauaaacggcuucgaaauugagucccauaagugcuacuguagccucuuuugcuguccauauugccggcacugcucuacagacaaagagauccauaagcugcaccuaagcaucuguaaaaagcguaaaaccgguuccaauguuaugcuggccgugugcaagcucauguguuucagagcuacuauggaagugucaaacagggcccuguuuauucgcaguaucauuaauacaaccuucguacuuugcauauugauccuggcagucugugugguuagcacgucugccguggagauggaaaacuuacccgcuggcacuugggagcgggaagaggaucucaccaauuucugccaucaagagugucaggucacagaaaccgagugccuguguccuuacgaagcccuugugcugagaaagccacuauuucucgacuccacugcaaaagggaugaagaaccugcucaauucaacaagucuggagaccagcuuauccauugaggcgcccuggggagcuaucaacguucagucuacauacaaaccuacugugucgaccgccaauauugcacucagcuggucauccguagaacacaggggcaacaagauccuggucagugggcgaucugagagcauaaugaaacuugaggaacgcacgggaaucuccugggaucugggcguggaagacgccucagagucuaaguugcucacagugagcgucauggaccugagucagauguauuccccgguuuucgaguaccuaagcggugaucggcaaguggaagaguggcccaaggcuaccugcacuggggacuguccagaaagaugcggaugcaccucuucaacaugucugcacaaagaguggccucauuccaggaauuggcguugcaaccccacuugguguuggggcguagguaccggcugcacguguugcgggcuugaugugaaggaccucuuuacagauuauauguucgucaaauggaagguggaauacauuaaaaccgaggccaucguuuguguggagcugacaagucaggaacgccagugcagcuugauugaggcaggaacacgguuuaaucugggcccagucaccaucacuuuaucggaaccuagaaacauacaacagaaguugcccccagagauuaucacacugcacccgaggaucgaagagggguucuuugaccuuaugcaugugcagaagguucugucugcuuccaccguguguaaauugcagagcugcacgcacggagucccuggcgaucuccaaguauaucauauugguaaucugcuaaagggggacaaagugaacggacaccugauacacaagaucgagccccauuucaacacuucauggaugaguugggauggcugugaccuugauuacuauugcaauaugggugacuggccaucuugcaccuacacaggcguuacccagcacaaccaugccuccuuugugaaucuccugaacauugaaacagauuacacuaaaaauuuccacuuucacagcaagcgagucaccgcgcauggggacacgccccaguuggacuuaaaggcccggccuacauauggagcuggcgagaucacugugcugguagaaguggcagauauggagcuccacaccaaaaagauugagaucucagggcugaaauucgccagucuugcuuguacaggaugcuacgccuguagcuccucuauaagcugcaagguccgcauccauguugacgaaccagaugagcugaccgugcacgugaaauccgacgaucccgacgucguggcagcgucaucuaguuugauggccagaaagcuagaauuuggcacugauucgaccuucaaggcuuucagcgccaugccuaaaacaucccuguguuuuuauauuguugagagggaacauugcaagucuuguucagaggaggacacgaaaaagugcguaaacacuaaacucgaacagccgcaaagcauccugauugagcacaaggguaccaucauagggaaacaaaauuccacauguaccgcaaaggcuaguugcuggcuugaaucugucaagagcuucuuuuacggacugaaaaacauguuaucaggcauuuucggcaauguguuuauggggaucuuccucuuuuuggccccauucauccugcucauucuguuuuucauguuuggauggcggauccuuuucuguuucaagugcugccgaagaacucgcggucuguuuaaauauaggcacuugaaggaugacgaggaaacaggcuaccgucggauaauugagaaacuaaacaauaagaaggggaaaaacaagcugcucgauggagagagauuagcagacggcaggaucgccgaacuguucuccaccaaaacgcauauugguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16963 - RNA, 5272 nt, Artificial Sequence
  mRNA product Design1 comprising derived and/or modified sequence from CCHFV(IbAr10200)__AF467768.2__GP (opt3)
gggagaaagcuuaccaugcacaucagccugauguacgccauucucugccuucagcuguguggcuugggggagacccauggaucccacaacgaaacaagacauaauaagacugacacgaugaccacacccggugauaacccuucuucagagccaccggugaguacugcuuuaagcauaacccuggaccccuccacagucaccccuacuacaccagcaucuggccuagaagggucgggagagguuuauaccucacccccuaucacgacuggcagccucccacugagugaaaccacacccgagcuuccugugacuaccgguacagauacccuguccgccggggacguagauccaucuacgcagacugcgggaggcacaagcgcuccgaccgugaggacuuccuugcccaauucaccuaguacaccaagcacaccccaggacacgcaccauccuguccggaaccuccugucugugaccuccccaggccccgaugagacaucaacuccgagcgggaccggaaaagaaaguucugccacauccagcccucaccccguuucgaaucgcccaccuacucccccagcaaccgcccagggucccacagagaacgacucucacaaugcuaccgaacauccugagucccugacucagucagcaacgccaggccucaugacaaguccgacccaaauugugcacccccagagcgccacuccuaucaccguccaggauacacauccaucccccaccaaccgaucuaagcguaauuuaaaaauggagauuauccugacucuuagccagggguugaagaaauacuauggaaagauacugagacuacuccaacugacacuugaagaggacacggaaggccuguuggaguggugcaagaggaaccucggucuggauugugacgauaccuucuuucagaaacggaucgaagaguucuuuauuacuggggagggacacuucaaugaaguguuacaguuucgcacaccuggcacccugucaacaacugagaguaccccagcuggccuccccacggccgaaccguucaaguccuacuuugcgaaaggguuccuuagcaucgacucuggauauuacucagcaaagugcuauagugguaccagcaacuccggccugcaguugauuaauaucacaagacacucuacuaggauaguagacaccccugggccaaaaauuacaaaccuaaagacuaucaauuguauuaaccugaaggccucgaucuuuaaagagcaucgggaaguugagaucaacgugcuccugccccaagucgcugugaaucuuagcaacugccacguggucauuaagucccauguuugugauuacucacuggacauagauggagccgugcgcuugccucacaucuaccaugagggcguauucauucccgguaccuauaaaaucgugauagacaagaaaaauaagcucaacgaucgaugcacgcuguuuacagacugugucauuaaagggagagaagugaggaagggccagaguguuuuacggcaguacaagaccgagauccguaucggaaaagcaucuacuggcagccgcagacugcuauccgaggaaccaucagaugacugcauuagcaggacacaacuccugcggaccgaaacugcugagauccacggggauaauuauggagguccuggcgacaagauuaccauauguaacgggucuacaaucguggaucagcgacuuggauccgaguugggcugcuacacgauuaaucgcgucagaaguuucaaacugugcgaaaacagcgccaccgguaagaauugugagaucgacucugugcccguaaaaugcaggcagggguauugucuccggaucacucaggaaggccgcggacacguuaagcuguccagaggcucagaggugguccuugacgcgugcgauacaaguugugagauuaugauaccaaaggggaccggagacauccugguggauugcagcgguggccaacagcauuuucuuaaagacaaccucauugaucugggguguccgaagaucccuuuacugggaaaaauggccauuuacaucugcaggaugucgaaucaccccaagacaacuauggcauuccuauucugguuuuccuucggcuaugucauaaccuguauccucugcaaagcuaucuuuuaccugcuuauuauuguggguacguuggggaagcgucugaagcaguaccgggaacucaaaccacagacauguaccaucugcgagacuacccccguuaacgccauagacgcugaaaugcaugaucugaauugcucuuauaacauuuguccuuacugcgccagccgauuaacaucagacggccuggcaagacacgugauccaauguccaaagaggaaagagaagguagaagagacugagcuuuauuugaaucucgaacgcauucccugggucgugcggaaacugcuacagguuagugaguccaccggaguggcccugaagagaucuagcuggcucaucguccugcuuguguuguucacaguaucccugucaccugugcagagcgcuccgauaggccaggggaagacgaucgaagcguacagggcacgcgagggauauaccaguauuugcuuauuuguucucggcucuauccuguucauugucuccugucuuaugaaaggucugguggauagcguggggaacucguuuuucccaggauugucaaucugcaagacuuguucuauaaguuccauuaacggcuuugaaaucgagagccacaaaugcuacuguucucucuucugcugucccuauugccgacauugcagcacagacaaggagauccacaaacugcaucuauccauuuguaagaaacggaagaaggguucaaaugucaugcuggccguuugcaaacucauguguuuucgugcuaccauggaagugaguaacagagcccuguucaucaggagcauuauaaauacuacauuugugcuuugcaucuugauucuggcaguaugugucgugucuaccuccgccguugagauggaaaacuuaccugcuggcacgugggagcgcgaagaggaucucacuaauuucugccaccaagagugucaggugaccgaaacagagugccuguguccauacgaagcccuuguccugcggaagccccuauuccucgacucaaccgcaaaagggaugaagaaccuguugaauaguacuagccuggagacauccuuaucuaucgaggcgccuuggggagcuauuaacgugcagucgaccuacaaaccgacaguuagcacugccaauaucgcacucucaugguccaguguggaacauagaggcaacaagauacugguaucugggaggagcgaguccaucaugaaacuugaggaacgaaccggaauuucaugggaucugggcgucgaagacgccucugagagcaaauugcucacggugagugugauggaccugucccagauguauagccccgucuuugaguaccuaucuggugaucgccaaguuggggaauggccaaaggcuacaugcaccggagacuguccugagcggugcggcugcacuucauccaccugucugcacaaagaauggccccacaguagaaauuggaggugcaacccaacaugguguuggggugugggcacugggugcaccuguugcggacuugauguaaaggaccucuucacggauuauauguuugugaaauggaaggucgaguacaucaagacagaagccauuguguguguugagcugaccagccaggagcgucagugcucguugaucgaagcaggcacucgcuucaaucuggggccugugacaauaaccuuaucugagccccggaacauucaacagaaacucccaccggaaaucaucacucugcauccuagaauugaggaaggauuuuucgaccuuaugcacguccagaaggugcuguccgcuagcacaguuuguaaauugcagucaugcacccauggcgugcccggugaucuccaagucuaucacauagggaaucugcuaaagggagacaaaguaaacggccaucugauccacaagauugagccacacuuuaacacgaguuggaugucuugggaugguugugaccuugauuacuauugcaauaugggcgacuggcccuccugcacuuacaccggggugacacagcauaaccacgccagcuucguuaaucuccugaacaucgagaccgauuacacaaagaauuuucauuuccacucaaaaagggugacugcgcacggagacaccccucaguuggacuuaaaggcccgaccaacguauggcgcuggggaaauuacaguccugguggagguagcagauauggaacuccauacuaaaaagaucgagauaaguggacugaaauuugccagccuugcuuguaccggcugcuacgccuguuccucugguaucagcugcaaggugcggauucacgucgacgagcccgaugaacugacaguucaugugaaauccgacgauccugacguggucgcagcgucaucuaguuugauggcccgcaagcuagaguucgggaccgauucgacuuuuaaggcuuucagcgccaugccgaaaaccucccuguguuucuauaucguggaaagagagcacugcaagucuuguucagaagaggacaccaaaaagugcguuaacacgaaacucgagcagccacaaagcauucugaucgaacauaagggaacuauaauuggcaagcaaaauuccaccuguacagcaaaagcuaguugcuggcuugagucuguaaagagcuuuuucuacggcuuaaagaacaugcugucagggaucuuuggaaauguguucauggguaucuuucucuucuuggcccccuuuauucugcucauccuguucuuuauguucggcuggaggauauuguuuuguuucaagugcugccggcgaaccagagggcuguucaaauaucgccacuugaaggaugacgaagagacuggauacaggcguauuaucgaaaagcuaaacaauaaaaagggcaaaaacaagcugcucgauggugagcgguuagcagacagaaggauugccgagcuguuuuccacaaaaacccacaucgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16964 - RNA, 5284 nt, Artificial Sequence
  mRNA product Design1 comprising derived and/or modified sequence from CCHFV(Turkey-Kelkit06)__GQ337054.1__GP (opt3)
gggagaaagcuuaccaugcccaccaacaucaugcacacaccucuggugugcuucauucucuaccuucagcuguuguguuuaggcggggcccauggacaacugaaugcuacugagcacaacgguacgaauaacaccacagcaccaggcgccagccaguccccgaagcccccuaugucuacuaccccaccccaugcgccugaaucaaguacaauaaaaccaaccacucccaucagcgaggcugaaggguccggagagacaaccucuccuccaaauacgacucagggccuaucgucaccggaaaccacaagcgagagacccgccacuaccaguauuuccacaucuagcaccgacuccacgaacccuacuacacagaugaccgauaauacuccaacacccaccgucucaacgaguccuucuucuuccccaucaacccccagcacaccgcaagguauccaccauccugcaaggagucuccugucuguuuccagccccaagacugugaccacaccaacuccuaccucgcccggggagaugucuuccgaaacaucaagucagcacagcgccaugucccggauuccaacuccccacacugcuacgcgcguaucuacagagaucaccaaccaucgaacuccucgucagagcgaaucaagugcacagcaaaccacaccauccccgaugaccagccccgcccagucuauacuucugaugucagcugccccuacugcggugcaggacauccacccaagucccacaaauagaagcaaaaggaacuuggagacggagauuauccucacccugucccagggacugaagaaauauuacggcaagauucucaaguuacugcaucuuacuuuggaacaagauacagagggccugcuagaauggugcaaagggaaucucggaucuaacugugacgaugacuuuuuccagaagcggaucgaggaauuuuucaugaccggugagugcuauuuuaaugagguccugcaguucaaaacacuuucgacucugagcccuaccgaaccaucccacgcacgcuugcccacggccgagccguuuaagucauacuucgcuaaaggcuuucucaguauagauucuggguauuucagcgccaaguguuacccuagauccucagcaagcggacugcaauuaauuaacgugacccagcacccagcuaggaucgccgaaacacccggcccuaagacuaccucucugaaaacaauuaauugcaucaaccuccgggcguccguuuuuaaggagcaucgcgaaguggagaucaacguccuucugccccagauugccgugaauuugaguaacugucacguaguuauaaauagccaugugugcgacuauucucuagauacugacgguccaguccgacugccuagaaucuaccacgaggggaccuucauucccggaacguacaaaaucgugauagauaagaaaaacaagcucaaugacagguguacacuggugaccaacugcgucauuaaaggccgggaaguucguaagggccaguccgugcuucgccaauauaagacugagaucaaaaucgggaaggcaucaacaggauuuagaaaacuguugagugaggaaccaggugaugacuguauuagcaggacccagcuccugcggacugaaaccgcugagauccaugacgauaauuacggcgggccgggagacaagauuacaauaugcaacggcucgacgaucguagaucagcgauuagguuccgagcuggggugcuauaccauuaaucgcgugaaaucuuucaagcuauguaagaacagcgccacuggcaaaacaugcgaagucgacucaaccccugugaaguguagacagggauucugccucaaaaucacacaagagggcagggggcacguuaagcugagucggggauccgaagugguccuugaugcuugugacucuagcugcgaggugaugauccccaaagguacuggcgauauuuugguagacuguuccgggggacagcagcacuuucugaaggauaaucucauagaccugggcugcccacauaucccccuucugggucgcauggccauuuacaucuguagaaugucaaaccacccuaggaccacgauggcauucuuguuuugguucagcuuuggguauguuauuacaugcaucuucuguaaggcccucuuuuacagucugauaaucauuggcaccuuagggaaaaagaucaaacaguaucgugagcugaagccacaaacuugcaccauuugcgaaacagcucccgugaaugcgaucgaugcagagaugcaugaccuaaacuguucuuacaauauaugcccuuacugugccucccggcucacuagcgacggccuggcucgacacgucacccagugcccgaaaagaaaggaaaagguggaggaaacagagcuuuauuugaaccuggagaggauuccauggaucguccgcaaacuccugcaagugucggaaucaacggggguugccuuaaagcggucuaguuggcugauugugcuuuugguacuccugaccgucucccuaagccccgugcagucugcaccuguuggacacgguaaaacuaucgagauauaccagacaagagaaggcuucgccagcaucugucuguuuaugcucggguccauucuguucaucgugucaugccuugucaagggauugguggauaguguaagcgagagcuuuuucccaggccuguccguguguaaaaccugcucaauugguaguguuaacggguuugaaaucgagagccauaaguguuauugcuccuuauucuguugccccuacugcaggcacuguucugcugaccgcgagauacaucagcuccaccugucgauuugcaaaaagcgaaagacuggcagcaaugucaugcuugccguguguaaacggaugugcuuccgugcaacaaucgaagcgucaagaagggcucuguugauccgcuccauuaucaacaccacguuugugauuuguauacucacucugaccaucugcgucguuaguacaucugccguggagauggaaaaucuaccugcaggaaccugggagcgggaagaggaucugacuaacuucugucaucaggagugccaagugacagaaaccgagugucucugcccguaugaagcccugguacuuagaaagcccuuguuucuggacagcauugucaaaggcaugaagaauuuacucaacuccacaucacuggagacuucucuuagcaucgaggcuccauggggagccauuaaugugcagaguaccuucaaaccuacgguuuccacagcaaacaucgcucugagcuggucuucagugguccacaggggaaauaagauauuggugaccggccgauccgaaaguaucaugaagcucgaggaacgcacugguguuagcugggaucuggggguggaggacgccucggaaucuaaauugcugaccguauccauuauggauuuaagccagauguacucacccgucuuugaguaucucaguggagacagacagguggaggaauggccaaaggcgacauguacuggcgauugcccugagcggugcgguuguaccucuuccacgugccugcacaaagaauggagccauucaaggaacuggcguuguaaucccacauggugcuggggcguggggaccggauguacuugcuguggcgucgacguuaaggaucuuuucacagaccacauguuugugaaauggaagguagaguacaucaagaccgaagccauugugugcgucgcucugaccagucaagagcgccaguguagcuugaucgaggcagggacacgguucaaccucggaccagugaccauaacgcuguccgaaccgagaaauauucagcagaaacuaccucccgagaucaucacucugcauccaaagauugaagagggcuuuuucgaucuuaugcacguucaaaaagugcucucugccagcaccgucugcaagcugcaguccuguacacaugguauacccggggaccuacagguguaccacaucggaaaccuguuaaaaggcgacaggguuaauggucaccucauucauaagaucgaaucacacuuuaacaccucuuggaugaguugggauggcugcgaccuggauuauuacugcaacaugggggacuggccuucguguacauauacuggagugacccagcauaaucacgcugccuucgucaaccuucugaauauugagacggauuacacaaagacuuuucacuuccauagcaaacgaguaaccgcacacggcgacacaccacaauuggaucucaaggcgcggcccaccuauggggccggaggcaucacugugcugguugagguggcugacauggaacuacauaccaaaaaggucgagauauccggucugaaauucgccucucuugcaugcacaggguguuacgcuugcucaagcggaaucuccuguaaggugcgcauucacguagaugaaccugacgagcucacggugcaugucaaaaguucugauccggacguuguggccgcaagcacuucacugauggccagaaaguuggaguuuggcaccgauuccacauucaaggcuuuuagugcgaugccaaaaaccagcuuaugcuucuauaucguggaaagggaguacuguaagucuugcuccgaagacgacacucagaaaugugucgauacacggcuggagcagccccaaucaauucucaucgaacacaaggguaccauaauuggcaaacagaacgacacgugcacugccaaggcaagcuguuggcuggagucggugaagucuuucuuuuacgggcuuaaaaauaugcugggaaguguuuuuggcaacuuguucaucgggauccuacuguuucucgcuccuuucguacugcuuguguuauuuuucauguucggauggaagauucuguuuugcuucaaaugcugucgaagaacacgcggccucuuuaaguauaggcacuugaaagaugacgaggaaaccgguuaccgucggaucauagagagacugaacuccaagaaggggaaaaauaggcuccuggauggagaccgccuugccgaucgaaagauugccgaacuguucagcaccaaaacucauaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16965 - RNA, 3796 nt, Artificial Sequence
  mRNA product Design1 comprising derived and/or modified sequence from CCHVF(10200)__U39455.2__SP-GP_Gn-NSm-Gc (opt3)
gggagaaagcuuaccaugcacaucagccugauguacgccauucucugccuucagcuguguggcuugggggagacccauggaucccacaacgaaacaucugaggaacccucagacgauugcgugaguagaacucaauuacugaggacggagaccgcugaaauacauggugacaauuauggcgggccuggagauaagaucacaauuuguaacggcagcacuaucgucgaccagcggcuagguuccgagcucgggugcuacaccauuaaucgcguucgaucuuucaaacugugugagaacucggcaacaggaaagaauugcgaaaucgauucagugccaguaaaaugucgucagggcuauugccuuagaauaacccaggagggcagggggcacgugaagcugagccggggaagugaagucguguuggacgccugugauacuuccugcgagaucaugauuccgaaagguacaggcgacauccucguugauuguucugggggacaacagcauuuucugaaggacaaccugauugaucucggcugccccaagaucccuuuacuggguaaaauggcgauauacauuugccgcaugagcaaucacccaaagaccacgauggcuuucuuguuuugguucuccuuuggguaugugaucacuuguauucuuugcaaagccaucuucuaccugcuaaucauugucggaacccucggcagaaggcugaagcaguaucgggagcuuaaaccccagacauguacuauaugcgaaaccacaccugugaacgcaaucgacgccgagaugcacgaucugaauuguucauacaacauuugcccauacugugcuagucgcuugaccagcgacggccucgcacgacauguaauccaaugccccaagagaaaggaaaaaguugaggaaacggagcuguauuuaaaucuggagaggauaccuugggugguccggaagcuccuucaggugucugaauccacugggguggcccugaaacguucaagcugguugauuguccuacugguucucuuuacagugagucugucuccaguacaguccgcuccgaucggacaggguaagaccaucgaggccuaccgcgcgagagaaggcuauacuagcauuugucuuuucgugcuggggucgaucuuguuuauugucucuugccucaugaaaggacugguggacuccguuggcaacucauucuuucccgguuuaaguauauguaagacaugcagcaucuccucuauuaauggguucgagaucgaaagccacaaaugcuacuguucacuguuuugcuguccuuauugcaggcauuguaguaccgauaaggagauccacaagcuacaccucuccauuugcaaaaagcggaaaacgggcagcaacgugaugcuggcagucuguaaacuuaugugcuuccgagccaccauggaggugucuaaucgcgcuuuguucauaagaucaaucauuaacacaacuuuuguacuguguauccucauucuggccguuugcguggucaguaccagcgcaguggaaauggagaaccuuccagcuggaacaugggaaagggaggaagaccugacuaauuucugucaucaagagugccaggucaccgagacagaaugcuugugucccuacgaggcccucgugcugcggaaaccuuuauuucuggauuccaccgcgaagggcaugaagaaccuacucaauucuacuucgcuggaaacgagccuuuccaucgaggccccauggggagcaauaaacguucagucaacauauaaacccaccgugaguacugcuaauaucgccuugucuuggagcuccguagagcaccgcgggaacaagauucuggucucagguagaagcgaaucuaucaugaaacucgaggaaaggaccggcauuuccugggaccuggggguggaggaugcuagugaaagcaaguuacugacaguuucugugauggaccuuucccaaauguacucaccggucuucgaguacuugaguggagaucgucagguggaggaauggccuaaagcaaccugcacuggcgacugucccgagcggugcgguuguacaagcucgacgugccuccauaaggaauggccacacucccgaaauuggagauguaacccuaccuggugcuggggcguagggacuggauguacaugcuguggccuggaugugaaggaccuauuuaccgauuauauguucguuaaauggaaggucgaguacaucaaaacagaagccauagugugcguggagcugacuucucaggagaggcagugcagccucauugaagccgggacccgcuuuaaucugggacccgucacgaucacccuuucagagccacggaacauucaacagaaguugcccccugaaaucauaacacugcauccaagaaucgaggaagguuucuuugacuuaaugcacguucagaaagugcucagugcuuccacuguguguaagcugcagucuugcacccacggcguaccgggggaccuucaagucuaucauauuggaaaucuguugaagggcgauaaagugaacggucaccucauccauaagauugagccccacuucaauacaagcuggauguccugggacgggugugaucuggacuacuauugcaacaugggcgauuggccuucauguacuuacaccggaguuacgcagcacaaucaugcgagcuuugugaaccuacugaacaucgagacagacuauaccaaaaauuuccacuuucauaguaagagggucacugcacacggcgauacaccacagcucgaccugaaagcccgccccaccuacggggcuggagaaauaacugugcuuguugagguggccgauauggaauugcauaccaagaaaauugagaucucuggccugaaguucgcauccuuagccugcacagguuguuacgcuugcagcucgucaaucucuuguaagguacggauucacgucgacgagccugaugaacucacggugcacgugaaaagugacgauccagacgucguugccgcauccagcucucugauggcgcgaaaacuugaguucgggaccgacagcacuuuuaaggcuuucuccgccaugcccaagacaucacugugcuuuuauaucguggaacgugagcauuguaagaguugcagcgaagaggauaccaagaagugcguaaacacaaaacuagagcagccgcaaucuauucucauagaacacaagggaacuaucauuggcaaacagaauagcaccuguacggcaaaggccucaugcuggcuggagagugugaaauccuucuuuuacgguuugaagaacaugcuguccggcaucuucgggaaugucuuuaugggaauuuucuuauuucucgcuccuuucauccugcuuauacuguuuuucauguuuggcuggagaaucuuguucuguuucaagugcuguaggcgcacacgggggcucuuuaaauauagacaucugaaggacgaugaagagaccggauacaggcgaauuaucgaaaaacuaaacaauaagaaaggcaagaacaagcugcuugacggugagcgccucgccgaugggcggauugcagagcuguucucuacuaaaacccacaucggaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16966 - RNA, 3769 nt, Artificial Sequence
  mRNA product Design1 comprising derived and/or modified sequence from CCHVF(10200)__U39455.2__IgE-leader_Gn-NSm-Gc (opt3)
gggagaaagcuuaccauggacuggaccuggauccuguuccucguggccgcugcaacaagaguccacagcuccgaggaacccucugaugacugcguuucaaggacucagcuucugcggacggagaccgccgaaauucauggcgauaacuacgggggaccuggugacaagauaacaaucuguaauggcaguacuauuguggaucaacgcuuggggagcgaguuaggaugcuauaccaucaaccgaguacguuccuuuaaacugugugaaaauucugcgacaggcaagaacugcgagauugacucggugccagucaaauguagacaggguuacugccuaaggaucacccaggaggggcggggacacgugaagcucucacgcggcagcgaaguugugcuggaugcuugugacaccaguugcgagauaaugaucccgaaaggcacaggggauauucuugucgacuguuccggaggucagcaacauuuccugaaggauaauuugaucgaccucggcugccccaagauuccucugcuggggaaaauggccaucuauauauguagaaugucuaaccacccaaagaccacgauggcauuucucuucugguuuagcuucggauacgugauuacuugcaucuuaugcaaagccaucuuuuaucugcuuauuaucguaggcaccuuggguaggcggcugaagcaguaccgcgaacuaaaaccccagacauguacuauuugcgagaccacaccuguuaaugcuauagaugcagagaugcaugaccucaacuguuccuauaauaucugcccauacugugccucacgacugaccagugacgggcuugcuagacacgugauucagugccccaagaggaaggaaaaagucgaggaaacggagcuguacuugaaccucgaacggaucccuuggguggugcguaagcuguuacaagucagcgagucuacuggaguugcccugaaacgcuccucauggcucauagugcuucugguauuguucacagugagccuaaguccaguccagucugcgccgauuggccagggcaagaccaucgaggcauauagagccagggaaggguacacuuccaucugucuguuugugcucggaagcauucuguucaucguuucgugccuuaugaaaggucugguggauucugucggcaauuccuuuuuccccggguugucaauuuguaagacaugcaguauaagcuccaucaacggauuugagauugaaucucacaaauguuauugcagccucuucugcuguccuuacugccggcauuguucaaccgacaaggagauccacaagcugcauuuaaguaucugcaaaaagcgaaaaacgggcuccaaugugaugcuggcuguauguaagcuaaugugcuuccgcgccaccauggaaguuagcaacagagcacucuuuauuaggucuauaaucaauacaacuuucgugcuguguauucuuaucuuggcugucugcguggucucaaccagugccguggagauggagaaccugccagcggguacaugggaacgggaggaagaucucacuaacuuuugucaccaggagugccaaguuaccgaaacagagugucugugccccuaugaggcccuugugcugcgcaaaccuuuguuccucgacagcaccgcaaaggggaugaagaaucuguuaaacuccacuucucuggaaacgucgcuaagcauugaggcuccauggggcgccaucaauguacaguccacauacaaacccaccgucucaacugcuaacauagcccucaguuggucuagcguggaacacagaggaaauaagauccugguuuccggcaggucagagagcauuaugaaacuugaggaacguaccgggaucucuugggauuugggaguggaggacgcauccgaaaguaagcugcucacagucagcgugauggaucugucucagauguauuccccgguauuugaguacuuaucaggugaccggcaaguggaagaguggccuaaagccacuugcacuggcgauugucccgagcgaugcggguguacaaguagcacgugccugcauaaggaauggccacacucgagaaacuggagguguaauccuaccuggugcuggggaguuggcacugguuguacaugcugugggcuugacgucaaggauuuguucaccgacuacauguuugugaaauggaagguggaguauauuaaaacagaagcuaucgucugcguugagcucacuucccaggaacgccaguguucucugauagaggcgggcacccgguucaaccuaggacccgugacgauuacccugagcgagccaagaaauauccagcaaaagcugcccccugaaauuaucacacuccauccaaggauagaggaaggcuuuuucgaccuuaugcacgugcagaaaguauugucagcaaguacugucugcaagcugcaguccugcacccauggggugccgggagauuuacagguuuaccacaucgguaaccuccugaagggcgacaaagugaaugggcaccuuauucauaagaucgagccccacuuuaacacaucuuggaugagcugggauggaugugaccuggauuauuacugcaauaugggcgacuggccuuccuguacuuauaccggugucacgcaacauaaccacgccucauucgugaauuugcucaacauugaaacagauuacaccaaaaacuuucacuuccauagcaagcgcguuacugcucacggggacacaccacagcuggaucuaaaagcccgacccaccuauggcgcaggagagaucacugugcugguagaggucgccgacauggaacuccauaccaagaaaauagagauuaguggccugaaguucgcuucucuugccugcacaggguguuacgcaugcuccagcucgaucucauguaaggugcggauccacguggaugaaccugacgaguugacgguccauguuaaaucugaugacccagacgugguagcggcuaguuccagccugauggcccguaaguuagaguuuggaaccgauucuacuuucaaagcauuuagcgccaugcccaagacaucccucugcuucuacauuguggaaagagagcacuguaaaucaugcagugaagaggacaccaagaagugugucaauacaaaacuggaacagccgcagagcauccuuauugagcacaagggcacuauaaucgguaaacaaaacucuaccugcacggcuaaggccuccugcuggcuggagucagugaaaaguuucuuuuaugggcuaaagaauaugcucagcggaauuuuuggcaacguuuucauggguaucuuucuguucuuggcaccuuuuauucuguuaauccucuucuuuauguucggcuggaggauacuguucuguuuuaagugcugucgccggacaagagggcuuuucaaauacaggcaucugaaggaugacgaagagaccggauaucgacgcaucauugaaaaauugaauaacaagaaaggcaagaauaagcuccuggauggggagcggcuagcugacggaagaaucgccgaacuguuuuccacuaaaacccacauuggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16967 - RNA, 3190 nt, Artificial Sequence
  mRNA product Design1 comprising derived and/or modified sequence from CCHVF(10200)__U39455.2__IgE-leader_Gn-4aa-Gc (opt3)
gggagaaagcuuaccauggacuggaccuggauccuguuccucguggccgcugcaacaagaguccacagcuccgaggaacccucugaugacugcguuucaaggacucagcuucugcggacggagaccgccgaaauucauggcgauaacuacgggggaccuggugacaagauaacaaucuguaauggcaguacuauuguggaucaacgcuuggggagcgaguuaggaugcuauaccaucaaccgaguacguuccuuuaaacugugugaaaauucugcgacaggcaagaacugcgagauugacucggugccagucaaauguagacaggguuacugccuaaggaucacccaggaggggcggggacacgugaagcucucacgcggcagcgaaguugugcuggaugcuugugacacaaguugcgagauaaugaucccgaaaggcacaggggauauucuugucgacuguuccggaggucagcaacauuuccugaaggauaauuugaucgaccucggcugccccaagauuccucugcuggggaaaauggccaucuauauauguagaaugucuaaccacccaaagaccacgauggcauuucucuucugguuuagcuucggauacgugauuacuugcaucuuaugcaaagccaucuuuuaucugcuuauuaucguaggcaccuuggguaggcggcugaagcaguaccgcgaacuaaaaccccagacauguacuauuugcgagaccacaccuguuaaugcuauagaugcagagaugcaugaccucaacuguuccuauaauaucugcccauacugugccucacgacugaccagugacgggcuugcuagacacgugauucagugccccaagaggaaggaaaaagucgaggaaacggagcuguacuugaaccucgaacggaucccuuggguggugcguaagcuguuacaagucagcgagucuacuggaguugcccugaaacgcuccucauggcucauagugcuucugguauuguucacagugagccuaaguccaguccagucugcgccgauuggcagaaagccccuguuucucgauuccaccgcaaaaggcaugaagaaucugcuuaacagcacuucgcuggagacaucuuuguccaucgaagccccuuggggagcuaucaaugugcagucaaccuauaaaccaacgguuaguaccgccaacauugcacucagcugguccucuguggagcacagggggaauaagauccuggucagcggucggucagaaaguauuaugaaguuagaggaacgaacaggcauauccugggaccuggggguggaggaugcuagcgagucuaaacuacucacuguaucaguuauggaccugagucagauguacagccccguguucgaauaucuuuccggagaucgccaagucgaggaauggccuaaggccaccuguacaggcgacugcccagagagaugugguugcacuucuucgaccuguuugcauaaagaauggccccacagcaggaacuggcggugcaacccgacauggugcuggggcguggggaccggauguacuugcuguggccuggaugucaaggaccucuuuacggauuacauguucgugaaauggaagguugaguauaucaagacagaggcgauugugugcguagaacugaccucccaggagcgccaguguucacuuaucgaagccgggacuagauuuaaucugggaccugucaccaucacauugagugagcccaggaacauucaacagaaacucccaccugagauaaucacccugcauccccguauugaagaggguuucuucgacuuaaugcacgugcagaagguucugucugcaagcacugugugcaaacuacaguccuguacacacggcgucccaggggaucuccaaguguaccauaucggaaaucugcuuaagggcgacaaaguaaacggucacuugauucauaagaucgaaccccacuuuaauacgucauggaugagcugggacgggugcgaucuggacuauuacuguaacaugggcgauuggccuucuugcaccuacacuggagugacacagcauaaucacgcuuccuucguuaaccuccugaauauagagaccgacuauacaaagaacuuucacuuccauaguaaacgggucacugcccacggcgauaccccacaguuagaccugaaggcucgaccgacguacggggccggagaaaucaccgugcuuguggaggucgcagauauggaguugcauacuaaaaagauugaaaucagcggucucaaauuugccucucuggcuuguacuggcugcuaugcgugcuccucaaguauuagcuguaagguuagaauccacguggacgagcccgaugaacuaaccgugcacguaaagucggacgauccugacgucguggcagccuccucuagccugauggcuaggaaacucgaguucgggacagauucaacuuuuaaggccuucagugcaaugccaaaaaccucccugugcuuuuacauaguugaacgcgagcauuguaagucuugcagcgaggaagacacgaaaaagugugugaauacaaaacuugagcagccccaauccauuuugaucgaacacaagggaaccauuaucggcaagcagaacucaacuugcacagccaaagcuagcuguuggcuggagagugucaagucuuucuuuuauggucucaaaaauauguuauccgggauauucggcaacguguuuaugggaaucuuccuguuccuugccccuuuuauucuguugauccucuucuuuauguucggcuggcggauucuguuuugcuucaaguguugcagaaggacccgcgggcuauuuaaauaccgacaucugaaggacgaugaagagacuggauaucggcguaucauagagaagcucaauaacaaaaagggcaaaaacaagcugcuugacggugaaagauuggcagaugggaggauugcggagcuguucagcaccaaaacacacaucggaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16968 - RNA, 1246 nt, Artificial Sequence
  mRNA product Design1 comprising derived and/or modified sequence from CCHVF(10200)__U39455.2__IgE-leader_Gn (opt3)
gggagaaagcuuaccauggacuggaccuggauccuguuccucguggccgcugcaacaagaguccacagcuccgaggaacccucugaugacugcguuucaaggacucagcuucugcggacggagaccgccgaaauucauggcgauaacuacgggggaccuggugacaagauaacaaucuguaauggcaguacuauuguggaucaacgcuuggggagcgaguuaggaugcuauaccaucaaccgaguacguuccuuuaaacugugugaaaauucugcgacaggcaagaacugcgagauugacucggugccagucaaauguagacaggguuacugccuaaggaucacccaggaggggcggggacacgugaagcucucacgcggcagcgaaguugugcuggaugcuugugacacaaguugcgagauaaugaucccgaaaggcacuggggauauucuugucgacuguuccggaggucagcaacauuuccugaaggauaauuugaucgaccucggcugccccaagauuccucugcuggggaaaauggccaucuauauauguagaaugucuaaccacccaaagaccacgauggcauuucucuucugguuuagcuucggauacgugauuacuugcaucuuaugcaaagccaucuuuuaucugcuuauuaucguaggcaccuuggguaggcggcugaagcaguaccgcgaacuaaaaccccagacauguacuauuugcgagaccacaccuguuaaugcuauagaugcagagaugcaugaccucaacuguuccuauaauaucugcccauacugugccucacgacugaccagugacgggcuugcuagacacgugauucagugccccaagaggaaggaaaaagucgaggaaacggagcuguacuugaaccucgaacggaucccuuggguggugcguaagcuguuacaagucagcgagucuacuggaguugcccugaaacgcuccucauggcucauagugcuucugguauuguucacagugagccuaaguccaguccagucugcgccgauuggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16969 - RNA, 2206 nt, Artificial Sequence
  mRNA product Design1 comprising derived and/or modified sequence from CCHVF(10200)__U39455.2__IgE-leader_Gc (opt3)
gggagaaagcuuaccauggacuggaccuggauccuguuccucguggccgcugcaacaagaguccacagcuuucuugauuccacugccaagggcaugaaaaaccuguuaaauucuacgucauuggagaccagucugagcauugaagcgcccuggggagcuauaaacguucaguccacauacaagccuacugugucuaccgccaauaucgcacuaucguggucaagcguagagcauagggggaacaaaauucucgugaguggucgguccgaaucuaucaugaagcuggaggaacgcacaggcauuagcugggaccuuggggucgaggaugccuccgagucaaaacuguugaccgugaguguuauggaccucagccagauguauucuccaguguucgaauaccuguccggagaucgacaggucgaggaauggccgaaggcuacuugcacaggcgacugucccgagcguugcgguuguaccucaagcacgugccugcacaaggaguggccucauaguagaaauuggagguguaacccaacuuggugcuggggaguggggaccggcuguacaugcuguggccucgauguaaaagacuuauuuacugauuauauguucguuaaguggaaaguggaauacaucaagaccgaggcaauagucugcguggaacugacaucucaggagcggcaguguucccuuaucgaagccgggacccgcuuuaauuugggacccgugacgauuacucugagcgagccuagaaacauccaacagaaacuaccacccgagauuaucacacuccacccuaggauagaagaggguuucuuugaccugaugcauguccagaagguucuuucggcuucuaccgugugcaagcugcaguccugcacucacggcguaccaggggauuugcaaguguaucacauuggaaaucuccugaaaggcgacaaggucaacggucauuuaauccacaaaauugaaccgcauuucaauacaucauggaugaguugggaugggugugaccuggacuacuauugcaacaugggagauuggcccagcuguaccuacacgggcgugacccagcacaaucacgccuccuuuguuaaccuccuuaauaucgagacagacuacacuaagaacuuccauuuucacucuaaacgggugaccgcgcauggcgauacaccucagcuggacuugaaggcacgcccaacuuauggggccggagaaaucaccguccuaguggagguagcugauauggagcugcacaccaaaaagauugaaauaagcggucucaaguucgccucacuggcaugcacaggcuguuacgcuugcaguuccagcaucucuuguaaaguucgaauccauguggacgagcccgaugaacuuacuguccacgugaagucagacgauccugacgucguggccgcgaguagcucccugauggccagaaaauuggaguuugggacggauucuacauucaaggcauucucggcuaugccaaaaaccagccucugcuuuuauauuguugaaagggagcacuguaaguccugcucagaggaagacacuaagaaaugugugaacaccaagcuggagcagccccaaaguauauuaauugaacauaaaggaacaaucaucggcaagcaaaauucuaccugcacugccaaagcuagcugcuggcuggaguccguaaagucauucuuuuacggucuaaagaacaugcucagcgggauuuucggcaaugucuuuaugggaaucuuccuguuucuugccccguucauuuugcugauacucuuuuucauguuuggcuggcggauccuguucuguuuuaaaugcugucgucgcacaagagggcuuuucaaguauaggcaccugaaagacgaugaggaaacgggauaccggcgaauuaucgagaaguugaacaauaaaaaggguaagaacaaacuccuggacggcgaacgcuuagcagaugggagaaucgccgagcuguucucuaccaagacucauauuggaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16970 - RNA, 1666 nt, Artificial Sequence
  mRNA product Design1 comprising derived and/or modified sequence from CCHFV(10200)__NC_005302.1/U88410.1__N (opt1)
gggagaaagcuuaccauggagaacaagaucgaggugaacaacaaggacgagaugaaccgcugguucgaggaguucaagaagggcaacgggcuggucgacaccuucaccaacagcuacuccuucugcgagagcgugcccaaccucgaccgguucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgacgugcccaagaucgagcagcugaccggguaccagcaggccgcccugaaguggcgcaaggacaucggcuuccgggugaacgcgaacaccgccgcccucagcaacaagguccuggccgaguacaaggugcccggcgagaucgugauguccgucaaggagaugcugagcgacaugauccgccggcgcaaccucauccugaaccgcgggggcgacgagaacccccgggggccggugucccacgagcacguggacuggugccgggaguucgucaagggcaaguacaucauggccuucaacccgcccuggggcgacaucaacaagagcgggcgcuccggcaucgcgcugguggccaccgggcucgccaagcuggccgagacggagggcaaggggaucuucgacgaggccaagaagaccguggaggcgcugaacggcuaccucgacaagcacaaggacgaggucgaccgggccagcgccgacuccaugaucaccaaccugcugaagcacaucgccaaggcccaggagcucuacaagaacagcuccgcgcugcgcgcccagagcgcccagaucgacaccgccuucagcuccuacuacuggcuguacaaggccggcgugacgcccgagaccuuccccaccgugagccaguuccucuucgagcuggggaagcagccccggggcaccaagaagaugaagaaggcgcugcucuccacgcccaugaagugggggaagaagcuguacgagcuguucgccgacgacagcuuccagcagaaccgcaucuacaugcaccccgccguccucaccgccggccggaucuccgagaugggggugugcuucggcaccaucccgguggcgaaccccgacgacgccgcccagggcagcgggcacaccaaguccauccugaaccugcgcacgaacaccgagaccaacaaccccugcgccaagaccaucgucaagcuguucgaggugcagaagacgggcuucaacauccaggacauggacaucgucgccagcgagcaccuccugcaccagucccucguggggaagcagagccccuuccagaacgcguacaacgugaagggcaacgccaccuccgccaacaucaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16971 - RNA, 1666 nt, Artificial Sequence
  mRNA product Design1 comprising derived and/or modified sequence from CCHFV(Turkey-Kelkit06)__GQ337053.1__N (opt1)
gggagaaagcuuaccauggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaaggacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcggggacgagaacccccgcggcccggucucccgggagcacguggaguggugccgcgaguucgugaaggggaaguacaucauggcguucaacccgcccuggggcgacaucaacaagagcgggcgguccggcaucgcccuggucgccaccggccucgccaagcuggccgagaccgaggggaagggcguguucgacgaggcgaagaagaccguggaggcccugaacggguaccucgacaagcaccgcgacgaggucgacaaggccagcgccgacuccaugaucacgaaccugcccaagcacaucgccaaggcgcaggagcuguacaagaacagcuccgcccuccgggcccagggcgcccagaucgacacccccuucagcagcuucuacuggcuguacaaggccggcgugacccccgagaccuuccccacgaucucccaguuccuguucgagcucggggagcagccccgcggcaccaagaagaugaagaaggcgcugcugagcaccccgaugaagugggggaagaagcucuacgagcuguucgccgacgacuccuuccagcagaaccggaucuacaugcaccccgccgugcugaccgccggccgcaucagcgagaugggggucugcuucggcacgauccccguggcgaaccccgacgacgccgcccagggcuccgggcacaccaagagcauccucaaccugcggaccuccaccgagacgaacaacccgugcgccaagaccaucgugaagcuguucgagauccaggagaccggcuucaacauccaggacauggacaucgucgccagcgagcaccuccugcaccaguccaucguggggaagcagagccccuuccagaacgcguacaacgucaagggcaacgccaccuccgccaacaucaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16972 - RNA, 5272 nt, Artificial Sequence
  mRNA product Design1 comprising derived and/or modified sequence from CCHFV(10200)__U39455.2__GP (opt1)
gggagaaagcuuaccaugcacaucagccugauguacgccauccucugccugcagcugugcggccucggggagacccacggcucccacaacgagacccgccacaacaagacggacaccaugaccacccacggggacaaccccagcuccgagccgcccgugagcacggcccuguccaucacccuggaccccagcaccgucacccccacgaccccggcguccggccucgaggggagcggcgagguguacaccuccccgcccaucaccacgggcagccugccccuguccgagaccacccccgagcuccccgugaccacggggaccgacacccugagcgccggcgacgucgaccccuccacccagacggccgggggcaccagcgcccccaccgugcggaccucccugccgaacagccccuccacgcccagcacgccccaggacacccaccacccggugcgcaaccuccuguccgucaccagccccgggcccgacgagaccagcacccccuccggcaccggcaaggagagcuccgccaccagcuccccgcaccccgugagcaaccggccgcccacgccgcccgcgaccgcccaggggcccaccgagaacgacucccacaacgccaccgagcaccccgagagccugacgcaguccgccacccccggccucaugaccagccccacccagaucgugcacccccaguccgcgaccccgaucacgguccaggacacccaccccagccccaccaaccgcuccaagcggaaccugaagauggagaucauccugacccucagccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgcccggcacccucuccaccaccgagagcacgccggccgggcugcccaccgccgagcccuucaaguccuacuucgccaagggcuuccugagcaucgacuccggcuacuacagcgccaagugcuacagcgggaccuccaacagcggccuccagcugaucaacaucacccgccacuccacgcggaucguggacacccccgggccgaagaucaccaaccugaagaccaucaacugcaucaaccucaaggcgagcaucuucaaggagcaccgcgaggucgagaucaacgugcugcugccccagguggccgucaaccucuccaacugccacguggugaucaagagccacgucugcgacuacucccuggacaucgacggcgccgugcggcugccccacaucuaccacgaggggguguucauccccggcacguacaagaucgucaucgacaagaagaacaagcucaacgaccgcugcacccuguucaccgacugcgugaucaagggccgggaggugcgcaaggggcagagcguccugcggcaguacaagaccgagauccgcaucggcaaggccuccacgggguuccggcgccuccugagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcagggcaagaccaucgaggccuaccgggcccgcgagggguacaccuccaucugccucuucguccugggcagcauccuguucaucguguccugccucaugaaggggcugguggacagcgucggcaacuccuucuuccccggccugagcaucugcaagacgugcagcaucuccagcaucaacggguucgagaucgagucccacaagugcuacugcagccucuucugcugcccguacugccggcacugcuccaccgacaaggagauccacaagcugcaccugagcaucugcaagaagcgcaagaccggcuccaacgugaugcucgccgugugcaagcugaugugcuuccgcgcgaccauggaggucagcaaccgggcccuguucauccgcuccaucaucaacacgaccuucgugcucugcauccugauccuggccgugugcgucgugagcaccuccgccguggagauggagaaccuccccgccgggaccugggagcgggaggaggaccugacgaacuucugccaccaggagugccaggucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16973 - RNA, 5272 nt, Artificial Sequence
  mRNA product Design1 comprising derived and/or modified sequence from CCHFV(IbAr10200)__AF467768.2__GP (opt1)
gggagaaagcuuaccaugcacaucagccugauguacgccauccucugccugcagcugugcggccucggggagacccacggcucccacaacgagacccgccacaacaagacggacaccaugaccacccccggggacaacccgagcuccgagccgcccgugagcacggcccuguccaucacccuggaccccagcaccgucacccccacgacccccgcguccggccucgaggggagcggcgagguguacaccuccccgcccaucaccacgggcagccugccccuguccgagaccacccccgagcuccccgugaccacggggaccgacacccugagcgccggcgacgucgaccccuccacccagacggccgggggcaccagcgccccgaccgugcggaccucccugcccaacagccccuccacgcccagcaccccgcaggacacccaccaccccgugcgcaaccuccuguccgucaccagccccgggcccgacgagacgagcacccccuccggcaccggcaaggagagcuccgccaccagcuccccgcaccccgugagcaaccggcccccgacgccgcccgcgaccgcccaggggcccaccgagaacgacucccacaacgccaccgagcaccccgagagccugacgcaguccgccacccccggccucaugaccagccccacccagaucgugcacccgcaguccgcgacccccaucacgguccaggacacccaccccagccccaccaaccgcuccaagcggaaccugaagauggagaucauccugacccucagccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgccgggcacccucuccaccaccgagagcacgcccgccgggcugcccaccgccgagcccuucaaguccuacuucgccaagggcuuccugagcaucgacuccggcuacuacagcgccaagugcuacagcgggaccuccaacagcggccuccagcugaucaacaucacccgccacuccacgcggaucguggacaccccggggcccaagaucaccaaccugaagaccaucaacugcaucaaccucaaggcgagcaucuucaaggagcaccgcgaggucgagaucaacgugcugcugccccagguggccgucaaccucuccaacugccacguggugaucaagagccacgucugcgacuacucccuggacaucgacggcgccgugcggcugccccacaucuaccacgaggggguguucaucccgggcacguacaagaucgucaucgacaagaagaacaagcucaacgaccgcugcacccuguucaccgacugcgugaucaagggccgggaggugcgcaaggggcagagcguccugcggcaguacaagaccgagauccgcaucggcaaggccuccacggggagccggcgccuccuguccgaggagcccagcgacgacugcaucucccggacccagcugcuccgcaccgagaccgccgagauccacggcgacaacuacgggggccccggcgacaagaucacgaucugcaacgggagcaccaucguggaccagcgccugggcuccgagcuggggugcuacaccaucaaccggguccgcagcuucaagcugugcgagaacuccgcgaccggcaagaacugcgagaucgacagcgugcccgugaagugccggcagggcuacugccuccgcaucacgcaggaggggcggggccacgucaagcugagccgcggguccgagguggugcuggacgccugcgacaccagcugcgagaucaugaucccgaagggcaccggggacauccucgucgacugcuccggcggccagcagcacuuccugaaggacaaccugaucgaccucgggugccccaagaucccccugcugggcaagauggccaucuacaucugccggaugagcaaccaccccaagaccacgauggccuuccucuucugguucuccuucggguacgugaucacgugcauccugugcaaggccaucuucuaccugcucaucaucgugggcacccuggggaagcgccugaagcaguaccgggagcucaagccgcagaccugcaccaucugcgagacgacccccgucaacgcgaucgacgccgagaugcacgaccugaacugcagcuacaacaucugccccuacugcgccucccgccugaccagcgacggccucgcccggcacgugauccagugccccaagcgcaaggagaagguggaggagaccgagcuguaccugaaccucgagcggaucccgugggucgugcgcaagcugcugcaggucuccgagagcacgggcgucgcccucaagcgguccagcuggcugaucgugcugcucgugcuguucaccgucucccugagccccgugcaguccgcgcccaucgggcagggcaagaccaucgaggccuaccgcgcccgggagggguacaccagcaucugccucuucgugcugggcuccauccuguucaucgucagcugccucaugaaggggcugguggacuccgugggcaacagcuucuucccgggccugagcaucugcaagacgugcuccaucagcuccaucaacggguucgagaucgagagccacaagugcuacugcucccucuucugcugccccuacugccgccacugcagcaccgacaaggagauccacaagcugcaccuguccaucugcaagaagcggaagaagggcagcaacgucaugcucgccgugugcaagcugaugugcuuccgcgcgaccauggagguguccaaccgcgcccuguucauccggagcaucaucaacaccacguucguccucugcauccugauccuggccgugugcguggucuccaccagcgccguggagauggagaaccuccccgccgggaccugggagcgcgaggaggaccugaccaacuucugccaccaggagugccaggugacggagaccgagugccugugccccuacgaggcgcucguccugcggaagccgcuguuccucgacuccaccgccaagggcaugaagaaccugcugaacagcaccucccucgagacgagccuguccaucgaggcccccuggggcgccaucaacgugcagagcaccuacaagcccaccguguccaccgccaacaucgcgcugagcuggagcuccgucgagcaccgcgggaacaagauccucgugagcggccgguccgagagcaucaugaagcuggaggagcgcacggggaucuccugggaccugggcguggaggacgccagcgaguccaagcuccugaccgucagcgugauggaccugucccagauguacagccccguguucgaguaccucuccggggaccggcaggucggcgaguggccgaaggccacgugcaccggcgacugccccgagcgcugcgggugcacgagcuccacgugccugcacaaggaguggccccacagccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccucccaggagcggcagugcagccugaucgaggccggcacgcgcuucaaccucggcccggugaccaucacccuguccgagccccggaacauccagcagaagcugccgcccgagaucaucacccuccacccccgcaucgaggagggguucuucgaccugaugcacgugcagaagguccugagcgcguccaccgugugcaagcuccagagcugcacgcacggcguccccggggaccugcaggucuaccacaucggcaaccugcucaagggggacaaggugaacggccaccugauccacaagaucgagccccacuucaacaccagcuggauguccugggacggcugcgaccuggacuacuacugcaacaugggggacuggcccagcugcaccuacaccggcgucacgcagcacaaccacgccuccuucgugaaccuccugaacaucgagaccgacuacaccaagaacuuccacuuccacagcaagcgggugaccgcccacggggacacgccgcagcuggaccucaaggcccgccccaccuacggcgcgggggagaucaccguccugguggagguggccgacauggagcugcacaccaagaagaucgagaucuccggccucaaguucgccagccuggccugcacgggcugcuacgccugcuccagcgggaucuccugcaagguccggauccacguggacgagcccgacgagcugaccgugcacgucaagagcgacgaccccgacgugguggcggccuccagcucccucauggcccgcaagcuggaguucggcaccgacagcaccuucaaggccuucuccgccaugccgaagacgagccugugcuucuacaucgucgagcgggagcacugcaaguccugcagcgaggaggacaccaagaagugcgugaacaccaagcucgagcagccccaguccauccugaucgagcacaaggggaccaucaucggcaagcagaacagcacgugcaccgcgaaggccagcugcuggcuggaguccgugaaguccuucuucuacggccugaagaacaugcucuccgggaucuucggcaacgucuucauggggaucuuccuguuccuggcccccuucauccuccugauccuguucuucauguucggcuggcgcauccucuucugcuucaagugcugccggcgcacccgcgggcuguucaaguaccggcaccugaaggacgacgaggagaccggcuaccgccggaucaucgagaagcucaacaacaagaagggcaagaacaagcugcuggacggggagcgccucgccgaccggcgcaucgccgagcuguucagcacgaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16974 - RNA, 5284 nt, Artificial Sequence
  mRNA product Design1 comprising derived and/or modified sequence from CCHFV(Turkey-Kelkit06)__GQ337054.1__GP (opt1)
gggagaaagcuuaccaugcccaccaacaucaugcacaccccgcuggugugcuucauccucuaccugcagcugcucugccugggcggggcccacggccagcugaacgccacggagcacaacgggaccaacaacaccaccgcgcccggcgccagccagucccccaagcccccgaugagcacgaccccgccccacgcccccgaguccagcaccaucaagccgaccacgcccaucuccgaggccgaggggagcggcgagaccaccuccccgcccaacaccacgcagggccucagcuccccggagaccaccagcgagcgccccgccaccacguccaucagcaccuccagcaccgacuccaccaaccccacgacccagaugaccgacaacacccccacgccgaccgucagcaccucccccagcuccagccccagcacccccuccacgccgcaggggauccaccaccccgcgcggagccugcuguccgugagcucccccaagaccgugaccacccccacgccgaccagccccggcgagauguccagcgagaccuccagccagcacuccgccaugagccgcauccccaccccgcacacggccacccgggucuccaccgagaucaccaaccaccgcaccccgcggcagagcgaguccagcgcccagcagacgacccccucccccaugaccagcccggcgcaguccauccuccugaugagcgccgcccccaccgccgugcaggacauccaccccagccccacgaaccgcuccaagcggaaccuggagaccgagaucauccucacccugagccaggggcugaagaaguacuacggcaagauccucaagcugcugcaccucacccuggagcaggacacggaggggcugcucgaguggugcaagggcaaccugggcuccaacugcgacgacgacuucuuccagaagcgcaucgaggaguucuucaugaccggggagugcuacuucaacgaggugcugcaguucaagacccucagcacccuguccccgacggagcccagccacgcccggcugcccaccgcggagcccuucaaguccuacuucgccaagggcuuccucagcaucgacuccggguacuucagcgccaagugcuacccgcgcuccagcgccuccggccugcagcugaucaacgucacccagcaccccgcccggaucgcggagacccccggccccaagacgaccagccucaagaccaucaacugcaucaaccugcgcgccuccguguucaaggagcaccgggagguggagaucaacguccugcucccgcagaucgccgugaaccugagcaacugccacguggucaucaacucccacgugugcgacuacagccuggacaccgacgggcccgugcgccucccccggaucuaccacgagggcacguucauccccgggaccuacaagaucgucaucgacaagaagaacaagcugaacgaccgcugcacccuggugaccaacugcgugaucaagggccgggagguccgcaaggggcagagcgugcuccggcaguacaagacggagaucaagaucggcaaggccuccaccggcuuccgcaagcugcugagcgaggagccgggggacgacugcaucucccggacccagcuccugcgcaccgagacggccgagauccacgacgacaacuacggcgggcccggcgacaagaucaccaucugcaacgggagcaccaucguggaccagcgccugggcuccgagcucggcugcuacaccaucaaccgggucaagagcuucaagcugugcaagaacuccgcgacggggaagaccugcgagguggacagcacccccgugaagugccgccagggcuucugccugaagaucacccaggaggggcggggccacgucaagcucucccgcgggagcgaggugguccuggacgccugcgacuccagcugcgaggugaugauccccaagggcacgggcgacauccugguggacugcuccgggggccagcagcacuuccugaaggacaaccucaucgaccuggggugcccgcacaucccccugcucggccggauggccaucuacaucugccgcaugagcaaccacccccggaccaccauggccuuccuguucugguucuccuucggcuacgucaucacgugcaucuucugcaaggcccuguucuacagccucaucaucaucgggacccugggcaagaagaucaagcaguaccgcgagcugaagccccagacgugcaccaucugcgagaccgcgccggugaacgccaucgacgccgagaugcacgaccucaacugcuccuacaacaucugccccuacugcgccagccggcugaccuccgacgggcuggcgcgccacgugacgcagugccccaagcggaaggagaaggucgaggagaccgagcucuaccugaaccuggagcgcaucccguggaucgugcggaagcuccuccaggugagcgagagcaccggcgucgcccugaagcgcuccagcuggcucaucgugcugcuggugcuccugaccgucucccugagccccgugcaguccgcccccguggggcacggcaagacgaucgagaucuaccagacccgggagggcuucgccagcaucugccucuucaugcugggguccauccuguucaucgucagcugccucgugaagggccugguggacuccgucagcgaguccuucuuccccgggcugagcgugugcaagaccugcuccaucggcagcgugaacggguucgagaucgagucccacaagugcuacugcagccucuucugcugcccguacugccgccacugcuccgccgaccgggagauccaccagcugcaccugagcaucugcaagaagcgcaagaccggcuccaacgucaugcucgcggugugcaagcggaugugcuuccgcgccacgaucgaggccagccgccgggcccugcugauccgcagcaucaucaacaccaccuucgugaucugcauccucacccugacgaucugcgucguguccaccagcgccguggagauggagaaccugcccgcgggcaccugggagcgggaggaggaccucaccaacuucugccaccaggagugccaggucacggagaccgagugccugugccccuacgaggcccuggugcuccgcaagccccuguuccuggacuccaucgugaaggggaugaagaaccuccugaacagcaccucccuggagaccagccucuccaucgaggccccguggggcgccaucaacguccagagcacguucaagcccaccguguccaccgccaacaucgcgcugagcugguccagcgugguccaccgggggaacaagauccuggugaccggccgcuccgagagcaucaugaagcucgaggagcggacggggguguccugggaccugggcgucgaggacgccagcgaguccaagcugcucaccgugagcaucauggaccugucccagauguacagccccguguucgaguaccugagcggcgaccgccaggucgaggaguggcccaaggcgaccugcaccggggacugcccggagcggugcggcugcacguccagcacgugccuccacaaggaguggucccacagccgcaacuggcggugcaaccccaccuggugcuggggcgugggcaccgggugcacgugcugcggcguggacgucaaggaccuguucaccgaccacauguucgugaaguggaagguggaguacaucaagaccgaggccaucgucugcguggcgcugaccucccaggagcgccagugcagccucaucgaggccggcacccgguucaaccuggggcccgugacgaucacccuguccgagccccgcaacauccagcagaagcucccgcccgagaucaucacccugcaccccaagaucgaggagggcuucuucgaccugaugcacguccagaaggugcucagcgccuccaccgugugcaagcugcagagcugcacgcacgggauccccggcgaccugcaggucuaccacaucggcaaccuccugaagggggaccgggugaacggccaccugauccacaagaucgagucccacuucaacaccagcuggauguccugggacgggugcgaccucgacuacuacugcaacaugggcgacuggccgagcugcaccuacaccggggucacgcagcacaaccacgccgccuucgugaaccugcugaacaucgagaccgacuacaccaagaccuuccacuuccacuccaagcgcgugacggcgcacggcgacaccccgcagcucgaccugaaggcccggcccaccuacggcgccgggggcaucaccguccugguggagguggccgacauggagcuccacacgaagaaggucgagaucagcgggcugaaguucgccucccuggcgugcaccggcugcuacgccugcagcuccgggaucagcugcaaggugcgcauccacguggacgagcccgacgagcucaccguccacgucaagagcuccgacccggacguggucgccgccagcaccucccugauggcccggaagcuggaguucggcacggacagcaccuucaaggcguucuccgccaugcccaagaccagccucugcuucuacaucguggagcgcgaguacugcaaguccugcagcgaggacgacacccagaagugcguggacacgcggcuggagcagccccaguccauccugaucgagcacaagggcaccaucaucgggaagcagaacgacacgugcaccgccaaggccagcugcuggcucgaguccgucaagagcuucuucuacggccugaagaacaugcugggguccguguucggcaaccucuucaucgggauccugcuguuccucgcgcccuucgugcugcugguccuguucuucauguucggcuggaagauccucuucugcuucaagugcugccgccgcacgcggggccuguucaaguaccgccaccugaaggacgacgaggagaccggguaccggcgcaucaucgagcggcucaacagcaagaagggcaagaaccgccugcuggacggggaccggcucgccgaccgcaagaucgccgagcuguucuccaccaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16975 - RNA, 3796 nt, Artificial Sequence
  mRNA product Design1 comprising derived and/or modified sequence from CCHVF(10200)__U39455.2__SP-GP_Gn-NSm-Gc (opt1)
gggagaaagcuuaccaugcacaucagccugauguacgccauccucugccugcagcugugcggccucggggagacccacggcucccacaacgagaccagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcagggcaagaccaucgaggccuaccgggcccgcgagggguacaccuccaucugccucuucguccugggcagcauccuguucaucguguccugccucaugaaggggcugguggacagcgucggcaacuccuucuuccccggccugagcaucugcaagacgugcagcaucuccagcaucaacggguucgagaucgagucccacaagugcuacugcagccucuucugcugcccguacugccggcacugcuccaccgacaaggagauccacaagcugcaccugagcaucugcaagaagcgcaagaccggcuccaacgugaugcucgccgugugcaagcugaugugcuuccgcgcgaccauggaggucagcaaccgggcccuguucauccgcuccaucaucaacacgaccuucgugcucugcauccugauccuggccgugugcgucgugagcaccuccgccguggagauggagaaccuccccgccgggaccugggagcgggaggaggaccugacgaacuucugccaccaggagugccaggucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16976 - RNA, 3769 nt, Artificial Sequence
  mRNA product Design1 comprising derived and/or modified sequence from CCHVF(10200)__U39455.2__IgE-leader_Gn-NSm-Gc (opt1)
gggagaaagcuuaccauggacuggaccuggauccuguuccucguggccgccgcgacccgcguccacagcagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcagggcaagaccaucgaggccuaccgggcccgcgagggguacaccuccaucugccucuucguccugggcagcauccuguucaucguguccugccucaugaaggggcugguggacagcgucggcaacuccuucuuccccggccugagcaucugcaagacgugcagcaucuccagcaucaacggguucgagaucgagucccacaagugcuacugcagccucuucugcugcccguacugccggcacugcuccaccgacaaggagauccacaagcugcaccugagcaucugcaagaagcgcaagaccggcuccaacgugaugcucgccgugugcaagcugaugugcuuccgcgcgaccauggaggucagcaaccgggcccuguucauccgcuccaucaucaacacgaccuucgugcucugcauccugauccuggccgugugcgucgugagcaccuccgccguggagauggagaaccuccccgccgggaccugggagcgggaggaggaccugacgaacuucugccaccaggagugccaggucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16977 - RNA, 3190 nt, Artificial Sequence
  mRNA product Design1 comprising derived and/or modified sequence from CCHVF(10200)__U39455.2__IgE-leader_Gn-4aa-Gc (opt1)
gggagaaagcuuaccauggacuggaccuggauccuguuccucguggccgccgcgacccgcguccacagcagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16978 - RNA, 1246 nt, Artificial Sequence
  mRNA product Design1 comprising derived and/or modified sequence from CCHVF(10200)__U39455.2__IgE-leader_Gn (opt1)
gggagaaagcuuaccauggacuggaccuggauccuguuccucguggccgccgcgacccgcguccacagcagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16979 - RNA, 2206 nt, Artificial Sequence
  mRNA product Design1 comprising derived and/or modified sequence from CCHVF(10200)__U39455.2__IgE-leader_Gc (opt1)
gggagaaagcuuaccauggacuggaccuggauccuguuccucguggccgccgcgacccgcguccacagcuuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16980 - RNA, 1666 nt, Artificial Sequence; identical to SEQ ID NO: 16970
  mRNA product Design1 comprising derived and/or modified sequence from CCHFV(10200)__NC_005302.1/U88410.1__N (opt1)

SEQ ID NO: 16981 - RNA, 1666 nt, Artificial Sequence; identical to SEQ ID NO: 16971
  mRNA product Design1 comprising derived and/or modified sequence from CCHFV(Turkey-Kelkit06)__GQ337053.1__N (opt1)

SEQ ID NO: 16982 - RNA, 5272 nt, Artificial Sequence
  mRNA product Design1 comprising derived and/or modified sequence from CCHFV(10200)__U39455.2__GP (opt1)
gggagaaagcuuaccaugcacaucagccugauguacgccauccucugccugcagcugugcggccucggggagacccacggcucccacaacgagacccgccacaacaagacggacaccaugaccacccacggggacaaccccagcuccgagccgcccgugagcacggcccuguccaucacccuggaccccagcaccgucacccccacgaccccggcguccggccucgaggggagcggcgagguguacaccuccccgcccaucaccacgggcagccugccccuguccgagaccacccccgagcuccccgugaccacggggaccgacacccugagcgccggcgacgucgaccccuccacccagacggccgggggcaccagcgcccccaccgugcggaccucccugccgaacagccccuccacgcccagcacgccccaggacacccaccacccggugcgcaaccuccuguccgucaccagccccgggcccgacgagaccagcacccccuccggcaccggcaaggagagcuccgccaccagcuccccgcaccccgugagcaaccggccgcccacgccgcccgcgaccgcccaggggcccaccgagaacgacucccacaacgccaccgagcaccccgagagccugacgcaguccgccacccccggccucaugaccagccccacccagaucgugcacccccaguccgcgaccccgaucacgguccaggacacccaccccagccccaccaaccgcuccaagcggaaccugaagauggagaucauccugacccucagccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgcccggcacccucuccaccaccgagagcacgccggccgggcugcccaccgccgagcccuucaaguccuacuucgccaagggcuuccugagcaucgacuccggcuacuacagcgccaagugcuacagcgggaccuccaacagcggccuccagcugaucaacaucacccgccacuccacgcggaucguggacacccccgggccgaagaucaccaaccugaagaccaucaacugcaucaaccucaaggcgagcaucuucaaggagcaccgcgaggucgagaucaacgugcugcugccccagguggccgucaaccucuccaacugccacguggugaucaagagccacgucugcgacuacucccuggacaucgacggcgccgugcggcugccccacaucuaccacgaggggguguucauccccggcacguacaagaucgucaucgacaagaagaacaagcucaacgaccgcugcacccuguucaccgacugcgugaucaagggccgggaggugcgcaaggggcagagcguccugcggcaguacaagaccgagauccgcaucggcaaggccuccacgggguuccggcgccuccugagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcagggcaagaccaucgaggccuaccgggcccgcgagggguacaccuccaucugccucuucguccugggcagcauccuguucaucguguccugccucaugaaggggcugguggacagcgucggcaacuccuucuuccccggccugagcaucugcaagacgugcagcaucuccagcaucaacggguucgagaucgagucccacaagugcuacugcagccucuucugcugcccguacugccggcacugcuccaccgacaaggagauccacaagcugcaccugagcaucugcaagaagcgcaagaccggcuccaacgugaugcucgccgugugcaagcugaugugcuuccgcgcgaccauggaggucagcaaccgggcccuguucauccgcuccaucaucaacacgaccuucgugcucugcauccugauccuggccgugugcgucgugagcaccuccgccguggagauggagaaccuccccgccgggaccugggagcgggaggaggaccugacgaacuucugccaccaggagugccaggucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccagcacgugccugcacaaggaguggccccacucccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16983 - RNA, 5272 nt, Artificial Sequence
  mRNA product Design1 comprising derived and/or modified sequence from CCHFV(IbAr10200)__AF467768.2__GP (opt1)
gggagaaagcuuaccaugcacaucagccugauguacgccauccucugccugcagcugugcggccucggggagacccacggcucccacaacgagacccgccacaacaagacggacaccaugaccacccccggggacaacccgagcuccgagccccccgugagcacggcccuguccaucacccuggaccccagcaccgucaccccgacgacccccgcguccggccucgaggggagcggcgagguguacaccuccccccccaucaccacgggcagccugccgcuguccgagaccacccccgagcuccccgugaccacggggaccgacacccugagcgccggcgacgucgaccccuccacccagacggccgggggcaccagcgccccgaccgugcggaccucccugcccaacagccccuccacgcccagcaccccgcaggacacccaccaccccgugcgcaaccuccuguccgucaccagccccgggcccgacgagacgagcaccccguccggcaccggcaaggagagcuccgccaccagcuccccccaccccgugagcaaccggcccccgacgccccccgcgaccgcccaggggcccaccgagaacgacucccacaacgccaccgagcacccggagagccugacgcaguccgccacccccggccucaugaccagccccacccagaucgugcacccgcaguccgcgacccccaucacgguccaggacacccaccccagccccaccaaccgcuccaagcggaaccugaagauggagaucauccugacccucagccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgccgggcacccucuccaccaccgagagcacgcccgccgggcugcccaccgccgagcccuucaaguccuacuucgccaagggcuuccugagcaucgacuccggcuacuacagcgccaagugcuacagcgggaccuccaacagcggccuccagcugaucaacaucacccgccacuccacgcggaucguggacaccccggggcccaagaucaccaaccugaagaccaucaacugcaucaaccucaaggcgagcaucuucaaggagcaccgcgaggucgagaucaacgugcugcugccccagguggccgucaaccucuccaacugccacguggugaucaagagccacgucugcgacuacucccuggacaucgacggcgccgugcggcugccccacaucuaccacgaggggguguucaucccgggcacguacaagaucgucaucgacaagaagaacaagcucaacgaccgcugcacccuguucaccgacugcgugaucaagggccgggaggugcgcaaggggcagagcguccugcggcaguacaagaccgagauccgcaucggcaaggccuccacggggagccggcgccuccuguccgaggagcccagcgacgacugcaucucccggacccagcugcuccgcaccgagaccgccgagauccacggcgacaacuacgggggccccggcgacaagaucacgaucugcaacgggagcaccaucguggaccagcgccugggcuccgagcuggggugcuacaccaucaaccggguccgcagcuucaagcugugcgagaacuccgcgaccggcaagaacugcgagaucgacagcgugcccgugaagugccggcagggcuacugccuccgcaucacgcaggaggggcggggccacgucaagcugagccgcggguccgagguggugcuggacgccugcgacaccagcugcgagaucaugaucccgaagggcaccggggacauccucgucgacugcuccggcggccagcagcacuuccugaaggacaaccugaucgaccucgggugccccaagaucccccugcugggcaagauggccaucuacaucugccggaugagcaaccaccccaagaccacgauggccuuccucuucugguucuccuucggguacgugaucaccugcauccugugcaaggccaucuucuaccugcucaucaucgugggcacccuggggaagcgccugaagcaguaccgggagcucaagccgcagaccugcaccaucugcgagacgacccccgucaacgcgaucgacgccgagaugcacgaccugaacugcagcuacaacaucugccccuacugcgccucccgccugaccagcgacggccucgcccggcacgugauccagugccccaagcgcaaggagaagguggaggagaccgagcuguaccugaaccucgagcggaucccgugggucgugcgcaagcugcugcagguguccgagagcacgggcgucgcccucaagcgguccagcuggcugaucgugcugcucgugcuguucaccgucucccugagccccgugcaguccgcgcccaucgggcagggcaagaccaucgaggccuaccgcgcccgggagggguacaccagcaucugccucuucgugcugggcuccauccuguucaucgucagcugccucaugaaggggcugguggacuccgugggcaacagcuucuucccgggccugagcaucugcaagacgugcuccaucagcuccaucaacggguucgagaucgagagccacaagugcuacugcucccucuucugcugccccuacugccgccacugcagcaccgacaaggagauccacaagcugcaccuguccaucugcaagaagcggaagaagggcagcaacgucaugcucgccgugugcaagcugaugugcuuccgcgcgaccauggagguguccaaccgcgcccuguucauccggagcaucaucaacaccacguucguccucugcauccugauccuggccgugugcguggucuccaccagcgccguggagauggagaaccuccccgccgggaccugggagcgcgaggaggaccugaccaacuucugccaccaggagugccaggugacggagaccgagugccugugccccuacgaggcgcucguccugcggaagccgcuguuccucgacuccaccgccaagggcaugaagaaccugcugaacagcaccucccucgagacgagccuguccaucgaggcccccuggggggccaucaacgugcagagcaccuacaagcccaccguguccaccgccaacaucgcgcugagcuggagcuccgucgagcaccgcggcaacaagauccucgugagcggccgguccgagagcaucaugaagcuggaggagcgcacggggaucuccugggaccugggcguggaggacgccagcgaguccaagcuccugaccgucagcgugauggaccugucccagauguacagccccguguucgaguaccucuccggggaccggcaggucggcgaguggccgaaggccaccugcaccggcgacugccccgagcgcugcgggugcacgagcuccaccugccugcacaaggaguggccccacagccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccucccaggagcggcagugcagccugaucgaggccggcacgcgcuucaaccucggcccggugaccaucacccuguccgagccccggaacauccagcagaagcugccccccgagaucaucacccuccacccgcgcaucgaggagggguucuucgaccugaugcacgugcagaagguccugagcgcguccaccgugugcaagcuccagagcugcacgcacggcguccccggggaccugcagguguaccacaucggcaaccugcucaagggggacaaggugaacggccaccugauccacaagaucgagccccacuucaacaccagcuggauguccugggacggcugcgaccuggacuacuacugcaacaugggggacuggcccagcugcaccuacaccggcgucacgcagcacaaccacgccuccuucgugaaccuccugaacaucgagaccgacuacaccaagaacuuccacuuccacagcaagcgggugaccgcccacggggacacgccgcagcuggaccucaaggcccgccccaccuacggcgcgggggagaucaccguccugguggagguggccgacauggagcugcacaccaagaagaucgagaucuccggccucaaguucgccagccuggccugcacgggcugcuacgccugcuccagcgggaucuccugcaagguccggauccacguggacgagcccgacgagcugaccgugcacgucaagagcgacgaccccgacgugguggcggccuccagcucccucauggcccgcaagcuggaguucggcaccgacagcaccuucaaggccuucuccgccaugccgaagacgagccugugcuucuacaucgucgagcgggagcacugcaaguccugcagcgaggaggacaccaagaagugcgugaacaccaagcucgagcagccccaguccauccugaucgagcacaaggggaccaucaucggcaagcagaacagcacgugcaccgcgaaggccagcugcuggcuggaguccgugaagagcuucuucuacggccugaagaacaugcucuccgggaucuucggcaacgucuucauggggaucuuccuguuccuggcccccuucauccuccugauccuguucuucauguucggcuggcgcauccucuucugcuucaagugcugccggcgcacccgcgggcuguucaaguaccggcaccugaaggacgacgaggagaccggcuaccgccggaucaucgagaagcucaacaacaagaagggcaagaacaagcugcuggacggggagcgccucgccgaccggcgcaucgccgagcuguucagcacgaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16984 - RNA, 5284 nt, Artificial Sequence
  mRNA product Design1 comprising derived and/or modified sequence from CCHFV(Turkey-Kelkit06)__GQ337054.1__GP (opt1)
gggagaaagcuuaccaugcccaccaacaucaugcacaccccgcuggugugcuucauccucuaccugcagcugcucugccugggcggggcccacggccagcugaacgccacggagcacaacgggaccaacaacaccaccgcgcccggcgccagccagucccccaagcccccgaugagcacgacccccccccacgcccccgaguccagcaccaucaagccgaccacgcccaucuccgaggccgaggggagcggcgagaccaccuccccccccaacaccacgcagggccucagcuccccggagaccaccagcgagcgccccgccaccacguccaucagcaccuccagcaccgacuccaccaaccccacgacccagaugaccgacaacacccccacgccgaccgucagcaccucccccagcuccagccccagcacccccuccacgccgcaggggauccaccaccccgcgcggagccugcuguccgugagcucccccaagaccgugaccacccccacgccgaccagccccggcgagauguccagcgagaccuccagccagcacuccgccaugagccgcauccccaccccccacacggccacccgggucuccaccgagaucaccaaccaccgcaccccgcggcagagcgaguccagcgcccagcagacgacccccucccccaugaccagcccggcgcaguccauccuccugaugagcgccgcccccaccgccgugcaggacauccaccccagccccacgaaccgcuccaagcggaaccuggagaccgagaucauccucacccugagccaggggcugaagaaguacuacggcaagauccucaagcugcugcaccucacccuggagcaggacacggaggggcugcucgaguggugcaagggcaaccugggcuccaacugcgacgacgacuucuuccagaagcgcaucgaggaguucuucaugaccggggagugcuacuucaacgaggugcugcaguucaagacccucagcacccuguccccgacggagcccagccacgcccggcugcccaccgcggagcccuucaaguccuacuucgccaagggcuuccucagcaucgacuccggguacuucagcgccaagugcuacccgcgcuccagcgccuccggccugcagcugaucaacgucacccagcaccccgcccggaucgcggagacccccggccccaagacgaccagccucaagaccaucaacugcaucaaccugcgcgccuccguguucaaggagcaccgggagguggagaucaacguccugcucccgcagaucgccgugaaccugagcaacugccacguggucaucaacucccacgugugcgacuacagccuggacaccgacgggcccgugcgccucccccggaucuaccacgagggcacguucauccccgggaccuacaagaucgucaucgacaagaagaacaagcugaacgaccgcugcacccuggugaccaacugcgugaucaagggccgggagguccgcaaggggcagagcgugcuccggcaguacaagacggagaucaagaucggcaaggccuccaccggcuuccgcaagcugcugagcgaggagccgggggacgacugcaucucccggacccagcuccugcgcaccgagacggccgagauccacgacgacaacuacggcgggcccggcgacaagaucaccaucugcaacgggagcaccaucguggaccagcgccugggcuccgagcucggcugcuacaccaucaaccgggucaagagcuucaagcugugcaagaacuccgcgacggggaagaccugcgagguggacagcacccccgugaagugccgccagggcuucugccugaagaucacccaggaggggcggggccacgucaagcucucccgcgggagcgaggugguccuggacgccugcgacuccagcugcgaggugaugauccccaagggcacgggcgacauccugguggacugcuccgggggccagcagcacuuccugaaggacaaccucaucgaccuggggugcccgcacaucccccugcucggccggauggccaucuacaucugccgcaugagcaaccacccccggaccaccauggccuuccuguucugguucuccuucggcuacgucaucaccugcaucuucugcaaggcccuguucuacagccucaucaucaucgggacccugggcaagaagaucaagcaguaccgcgagcugaagccccagacgugcaccaucugcgagaccgcgccggugaacgccaucgacgccgagaugcacgaccucaacugcuccuacaacaucugccccuacugcgccagccggcugaccuccgacgggcuggcgcgccacgugacgcagugccccaagcggaaggagaaggucgaggagaccgagcucuaccugaaccuggagcgcaucccguggaucgugcggaagcuccugcaggugagcgagagcaccggcgucgcccugaagcgcuccagcuggcucaucgugcugcuggugcuccugaccgucucccugagccccgugcaguccgcccccguggggcacggcaagacgaucgagaucuaccagacccgggagggcuucgccagcaucugccucuucaugcugggguccauccuguucaucgucagcugccucgugaagggccugguggacuccgucagcgaguccuucuuccccgggcugagcgugugcaagaccugcuccaucggcagcgugaacggguucgagaucgagucccacaagugcuacugcagccucuucugcugcccguacugccgccacugcuccgccgaccgggagauccaccagcugcaccugagcaucugcaagaagcgcaagaccggcuccaacgucaugcucgcggugugcaagcggaugugcuuccgcgccacgaucgaggccagccgccgggcccugcugauccgcagcaucaucaacaccaccuucgugaucugcauccucacccugacgaucugcgucguguccaccagcgccguggagauggagaaccugcccgcgggcaccugggagcgggaggaggaccucaccaacuucugccaccaggagugccaggucacggagaccgagugccugugccccuacgaggcccuggugcuccgcaagccccuguuccuggacuccaucgugaaggggaugaagaaccuccugaacagcaccucccuggagaccagccucuccaucgaggccccguggggcgccaucaacguccagagcacguucaagcccaccguguccaccgccaacaucgcgcugagcugguccagcgugguccaccgggggaacaagauccuggugaccggccgcuccgagagcaucaugaagcucgaggagcggacggggguguccugggaccugggcgucgaggacgccagcgaguccaagcugcucaccgugagcaucauggaccugucccagauguacagccccguguucgaguaccugagcggcgaccgccaggucgaggaguggcccaaggccaccugcaccggggacugcccggagcggugcggcugcacguccagcaccugccuccacaaggaguggucccacagccgcaacuggcggugcaaccccaccuggugcuggggggugggcaccgggugcacgugcugcggcguggacgucaaggaccuguucaccgaccacauguucgugaaguggaagguggaguacaucaagaccgaggccaucgucugcguggcgcugaccucccaggagcgccagugcagccucaucgaggccggcacccgguucaaccuggggcccgugacgaucacccuguccgagccccgcaacauccagcagaagcucccgcccgagaucaucacccugcaccccaagaucgaggagggcuucuucgaccugaugcacguccagaaggugcucagcgccuccaccgugugcaagcugcagagcugcacgcacgggauccccggcgaccugcaggucuaccacaucggcaaccuccugaagggggaccgggugaacggccaccugauccacaagaucgagucccacuucaacaccagcuggauguccugggacgggugcgaccucgacuacuacugcaacaugggcgacuggccgagcugcaccuacaccggggucacgcagcacaaccacgccgccuucgugaaccugcugaacaucgagaccgacuacaccaagaccuuccacuuccacuccaagcgcgugacggcgcacggcgacaccccccagcucgaccugaaggcccggcccaccuacggcgccgggggcaucaccguccugguggagguggccgacauggagcuccacacgaagaaggucgagaucagcgggcugaaguucgccucccuggcgugcaccggcugcuacgccugcagcuccgggaucagcugcaaggugcgcauccacguggacgagcccgacgagcucaccguccacgugaagagcuccgacccggacguggucgccgccagcaccucccugauggcccggaagcuggaguucggcacggacagcaccuucaaggcguucuccgccaugcccaagaccagccucugcuucuacaucguggagcgcgaguacugcaaguccugcagcgaggacgacacccagaagugcguggacacgcggcuggagcagccccaguccauccugaucgagcacaagggcaccaucaucgggaagcagaacgacaccugcaccgccaaggccagcugcuggcucgaguccgucaagagcuucuucuacggccugaagaacaugcugggguccguguucggcaaccucuucaucgggauccugcuguuccucgcgcccuucgugcugcugguccuguucuucauguucggcuggaagauccucuucugcuucaagugcugccgccgcacgcggggccuguucaaguaccgccaccugaaggacgacgaggagaccggguaccggcgcaucaucgagcggcucaacagcaagaagggcaagaaccgccugcuggacggggaccggcucgccgaccgcaagaucgccgagcuguucuccaccaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16985 - RNA, 3796 nt, Artificial Sequence
  mRNA product Design1 comprising derived and/or modified sequence from CCHVF(10200)__U39455.2__SP-GP_Gn-NSm-Gc (opt1)
gggagaaagcuuaccaugcacaucagccugauguacgccauccucugccugcagcugugcggccucggggagacccacggcucccacaacgagaccagcgaggagcccuccgacgacugcgugagccgcacgcagcugcugcggaccgagaccgccgagauccacggggacaacuacggcgggccgggcgacaagaucaccaucugcaacggcuccacgaucgucgaccagcgccucgggagcgagcugggcugcuacaccaucaaccgggugcgcuccuucaagcugugcgagaacagcgcgaccgggaagaacugcgagaucgacuccgugcccgucaagugccggcagggcuacugccuccgcaucacccaggaggggcggggccacgugaagcugagccgcggcuccgaggugguccuggacgccugcgacacgagcugcgagaucaugauccccaaggggaccggcgacauccucguggacugcuccgggggccagcagcacuuccugaaggacaaccugaucgaccucggcugccccaagaucccgcugcuggggaagauggccaucuacaucugccggaugagcaaccaccccaagaccaccauggccuuccucuucugguucuccuucggcuacgugaucacgugcauccugugcaaggccaucuucuaccugcucaucaucgucgggacccugggccgccggcugaagcaguaccgcgagcucaagccccagaccugcaccaucugcgagacgacccccgugaacgcgaucgacgccgagaugcacgaccugaacugcagcuacaacaucugcccguacugcgccucccggcugaccagcgacgggcucgcccgccacgugauccagugccccaagcggaaggagaaggucgaggagaccgagcuguaccugaaccucgagcgcauccccuggguggugcggaagcugcugcaggucuccgagagcacgggcguggcgcucaagcgcagcuccuggcugaucgugcugcucguccuguucaccgugagccugucccccgugcagagcgccccgaucggccaggggaagaccaucgaggccuaccgggcccgcgagggcuacaccuccaucugccucuucguccuggggagcauccuguucaucguguccugccucaugaagggccugguggacagcgucgggaacuccuucuuccccggccugagcaucugcaagacgugcuccaucagcuccaucaacggcuucgagaucgagagccacaagugcuacugcucccucuucugcugccccuacugccggcacugcagcaccgacaaggagauccacaagcugcaccuguccaucugcaagaagcgcaagaccgggagcaacgugaugcucgccgucugcaagcugaugugcuuccgcgcgaccauggagguguccaaccgggcccuguucauccgcagcaucaucaacacgaccuucgugcugugcauccucauccuggccgucugcguggugagcaccuccgccgucgagauggagaaccugcccgccggcaccugggagcgggaggaggaccucacgaacuucugccaccaggagugccaggugaccgagaccgagugccugugcccguacgaggcgcuggugcuccgcaagccccuguuccuggacagcaccgccaaggggaugaagaaccuccugaacuccacgagccuggagaccucccucagcaucgaggcccccuggggcgccaucaacguccaguccaccuacaagcccaccgugagcaccgccaacaucgcgcuguccuggagcuccguggagcaccgggggaacaagauccuggucagcggccgcuccgagagcaucaugaagcucgaggagcggacgggcaucuccugggaccuggggguggaggacgccagcgaguccaagcugcucaccgugagcgucauggaccugagccagauguacuccccgguguucgaguaccugagcggcgaccgccagguggaggaguggcccaaggccaccugcaccggggacugccccgagcggugcggcugcacguccagcaccugccuccacaaggaguggccccacucccgcaacuggcggugcaacccgaccuggugcuggggcgucgggaccggcugcacgugcugcgggcuggacgugaaggaccuguucaccgacuacauguucgugaaguggaaggucgaguacaucaagaccgaggccaucgugugcguggagcucaccagccaggagcgccagugcucccugaucgaggccggcacgcgguucaaccuggggcccgucaccaucacccucagcgagccccgcaacauccagcagaagcugcccccggagaucaucacccugcacccccggaucgaggagggcuucuucgaccucaugcacgugcagaaggugcuguccgcgagcacggucugcaagcugcaguccugcacccacggcgugcccggggaccuccagguguaccacaucggcaaccugcugaagggggacaaggucaacggccaccucauccacaagaucgagccgcacuucaacaccagcuggauguccugggacgggugcgaccuggacuacuacugcaacaugggcgacuggcccagcugcaccuacacgggcgugacccagcacaaccacgccuccuucgugaaccugcucaacaucgagaccgacuacaccaagaacuuccacuuccacagcaagcgcgucacggcccacggggacaccccccagcuggaccugaaggcccggcccaccuacggcgcgggggagaucaccgugcucguggaggucgccgacauggagcugcacacgaagaagaucgagaucuccggccugaaguucgccagccucgccugcaccgggugcuacgccugcuccagcagcaucuccugcaaggugcgcauccacguggacgagccggacgagcugaccguccacgugaagagcgacgaccccgacguggucgcggccuccagcucccugauggcccggaagcucgaguucggcaccgacagcacguucaaggccuucuccgccaugcccaagaccagccugugcuucuacaucguggagcgcgagcacugcaaguccugcagcgaggaggacaccaagaagugcgugaacaccaagcuggagcagccccaguccauccucaucgagcacaagggcacgaucaucgggaagcagaacagcaccugcaccgcgaaggccuccugcuggcuggagagcgucaaguccuucuucuacggccugaagaacaugcucagcgggaucuucggcaacguguucauggggaucuuccuguuccuggccccguucauccuccugauccuguucuucauguucggcuggcgcauccucuucugcuucaagugcugccggcgcacccggggccuguucaaguaccgccaccugaaggacgacgaggagaccggguaccggcgcaucaucgagaagcucaacaacaagaagggcaagaacaagcugcuggacggggagcggcucgccgacggccgcaucgccgagcuguucuccacgaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16986 - RNA, 3769 nt, Artificial Sequence
  mRNA product Design1 comprising derived and/or modified sequence from CCHVF(10200)__U39455.2__IgE-leader_Gn-NSm-Gc (opt1)
gggagaaagcuuaccauggacuggaccuggauccuguuccucguggccgccgcgacccgcguccacagcuccgaggagcccagcgacgacugcgugucccggacgcagcugcugcgcaccgagaccgccgagauccacggcgacaacuacgggggcccgggggacaagaucaccaucugcaacggcagcacgaucguggaccagcggcucggguccgagcugggcugcuacaccaucaaccgcguccggagcuucaagcugugcgagaacuccgccaccggcaagaacugcgagaucgacagcgugcccgugaagugccgccagggguacugccuccggaucacccaggagggccgcgggcacgucaagcugucccggggcagcgagguggugcuggacgccugcgacacguccugcgagaucaugauccccaaggggaccggcgacauccucgucgacugcagcggcgggcagcagcacuuccugaaggacaaccugaucgaccucggcugccccaagaucccgcugcuggggaagauggccaucuacaucugccgcauguccaaccaccccaagaccaccauggcguuccucuucugguucagcuucggcuacgugaucacgugcauccugugcaaggccaucuucuaccugcucaucaucgugggcacccuggggcggcgccugaagcaguaccgggagcucaagccccagaccugcaccaucugcgagacgacccccgucaacgccaucgacgccgagaugcacgaccugaacugcuccuacaacaucugcccguacugcgcgagccgccugaccuccgacggccucgcccggcacgugauccagugccccaagcgcaaggagaagguggaggagaccgagcuguaccugaaccucgagcggauccccugggucgugcgcaagcugcugcaggugagcgaguccacgggggucgcccucaagcggagcagcuggcugaucgugcugcucgugcuguucaccgucucccugagccccgugcaguccgccccgaucggccaggggaagaccaucgaggccuaccgcgcgcgggagggcuacaccagcaucugccucuucgugcugggcuccauccuguucaucgucagcugccucaugaaggggcugguggacuccgucggcaacagcuucuuccccgggcuguccaucugcaagacgugcagcaucuccagcaucaacggcuucgagaucgagucccacaagugcuacugcagccucuucugcugccccuacugccgccacugcuccaccgacaaggagauccacaagcugcaccugagcaucugcaagaagcgcaagaccggguccaacgugaugcucgccgugugcaagcugaugugcuuccgggccaccauggaggucagcaaccgcgcccuguucauccgguccaucaucaacacgaccuucgugcucugcauccugauccuggccgugugcgucgugagcaccagcgcgguggagauggagaaccugcccgccggcaccugggagcgcgaggaggaccucacgaacuucugccaccaggagugccaggucaccgagaccgagugccugugcccguacgaggcccuggugcuccggaagccccuguuccuggacuccaccgccaagggcaugaagaaccuccugaacagcacgucccuggagaccagccucuccaucgaggcccccuggggggcgaucaacgugcagagcaccuacaagcccaccgucuccaccgccaacaucgcccugagcugguccagcguggagcaccgcggcaacaagauccugguguccgggcggagcgaguccaucaugaagcucgaggagcgcacgggcaucagcugggaccugggggucgaggacgccuccgagagcaagcugcucaccguguccgugauggaccugagccagauguacagcccggucuucgaguaccuguccggcgaccggcagguggaggaguggcccaaggccaccugcaccggcgacugccccgagcgcugcgggugcacgagcuccaccugccuccacaaggaguggccccacagccggaacuggcgcugcaacccgaccuggugcuggggcguggggaccggcugcacgugcugcggccuggacgucaaggaccuguucaccgacuacauguucgugaaguggaagguggaguacaucaagaccgaggcgaucgucugcguggagcucaccucccaggagcggcagugcagccugaucgaggccgggacgcgcuucaaccugggccccgugaccaucacccucuccgagccccggaacauccagcagaagcugcccccggagaucaucacccugcacccccgcaucgaggagggguucuucgaccucaugcacguccagaaggugcugagcgccuccacggugugcaagcugcagagcugcacccacggcguccccggggaccuccagguguaccacaucggcaaccugcugaagggcgacaaggugaacgggcaccucauccacaagaucgagccgcacuucaacaccuccuggaugagcugggacggcugcgaccuggacuacuacugcaacaugggggacuggcccuccugcaccuacacgggcgucacccagcacaaccacgccagcuucgugaaccugcucaacaucgagaccgacuacaccaagaacuuccacuuccacuccaagcgggugacggcgcacggggacaccccccagcuggaccugaaggcccgccccaccuacggcgccggcgagaucaccguccucguggagguggccgacauggagcugcacacgaagaagaucgagaucagcgggcugaaguucgccucccucgcgugcaccggcugcuacgccugcagcuccagcaucagcugcaagguccggauccacguggacgagccggacgagcugaccgugcacgucaaguccgacgaccccgacgugguggccgccagcuccagccugauggcccgcaagcucgaguucgggaccgacuccacguucaaggcguucagcgccaugcccaagaccucccugugcuucuacaucgucgagcgcgagcacugcaagagcugcuccgaggaggacaccaagaagugcgugaacaccaagcuggagcagccccagagcauccucaucgagcacaagggcacgaucaucgggaagcagaacuccaccugcaccgccaaggccagcugcuggcuggaguccgugaagagcuucuucuacggccugaagaacaugcucuccggcaucuucgggaacgucuucaugggcaucuuccuguuccuggccccguucauccuccugauccuguucuucauguucggguggcggauccucuucugcuucaagugcugccgccggacccgcggccuguucaaguaccggcaccugaaggacgacgaggagaccggguaccgccggaucaucgagaagcucaacaacaagaagggcaagaacaagcugcuggacggcgagcgccucgcggacgggcggaucgccgagcuguucagcacgaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16987 - RNA, 3190 nt, Artificial Sequence
  mRNA product Design1 comprising derived and/or modified sequence from CCHVF(10200)__U39455.2__IgE-leader_Gn-4aa-Gc (opt1)
gggagaaagcuuaccauggacuggaccuggauccuguuccucguggccgccgcgacccgcguccacagcuccgaggagcccagcgacgacugcgugucccggacgcagcugcugcgcaccgagaccgccgagauccacggcgacaacuacgggggcccgggggacaagaucaccaucugcaacggcagcacgaucguggaccagcggcucggguccgagcugggcugcuacaccaucaaccgcguccggagcuucaagcugugcgagaacuccgccaccggcaagaacugcgagaucgacagcgugcccgugaagugccgccagggguacugccuccggaucacccaggagggccgcgggcacgucaagcugucccggggcagcgagguggugcuggacgccugcgacacguccugcgagaucaugauccccaaggggaccggcgacauccucgucgacugcagcggcgggcagcagcacuuccugaaggacaaccugaucgaccucggcugccccaagaucccgcugcuggggaagauggccaucuacaucugccgcauguccaaccaccccaagaccaccauggcguuccucuucugguucagcuucggcuacgugaucacgugcauccugugcaaggccaucuucuaccugcucaucaucgugggcacccuggggcggcgccugaagcaguaccgggagcucaagccccagaccugcaccaucugcgagacgacccccgucaacgccaucgacgccgagaugcacgaccugaacugcuccuacaacaucugcccguacugcgcgagccgccugaccuccgacggccucgcccggcacgugauccagugccccaagcgcaaggagaagguggaggagaccgagcuguaccugaaccucgagcggauccccugggucgugcgcaagcugcugcaggugagcgaguccacgggggucgcccucaagcggagcagcuggcugaucgugcugcucgugcuguucaccgucucccugagccccgugcaguccgccccgaucggccgcaagccccucuuccuggacagcaccgccaaggggaugaagaaccugcucaacuccaccagccuggagacgucccugagcaucgaggcgcccuggggcgccaucaacgugcaguccaccuacaagcccaccgucagcaccgccaacaucgcccucuccuggagcuccguggagcaccggggcaacaagauccuggucagcgggcgcuccgagagcaucaugaagcuggaggagcgcacgggcaucuccugggaccucgggguggaggacgccagcgaguccaagcugcugaccgugagcgucauggaccucagccagauguacuccccgguguucgaguaccugagcggcgaccggcagguggaggaguggcccaaggcgaccugcaccggggacugccccgagcgcugcggcugcacguccagcaccugccugcacaaggaguggccccacucccggaacuggcgcugcaacccgaccuggugcuggggcgucgggaccggcugcacgugcugcgggcuggacgugaaggaccucuucaccgacuacauguucgugaaguggaaggucgaguacaucaagaccgaggccaucgugugcguggagcugaccagccaggagcggcagugcucccugaucgaggccggcacccgcuucaaccucgggcccgucacgaucacccugagcgagccccggaacauccagcagaagcugcccccggagaucaucacccuccacccccgcaucgaggagggcuucuucgaccugaugcacgugcagaaggugcuguccgccagcaccgucugcaagcuccaguccugcacgcacggcgugcccggggaccugcagguguaccacaucggcaaccugcucaagggggacaaggucaacggccaccugauccacaagaucgagccccacuucaacaccagcuggauguccugggacggcugcgaccuggacuacuacugcaacaugggggacuggccgagcugcaccuacaccggcgugacgcagcacaaccacgccuccuucgugaaccuccugaacaucgagaccgacuacaccaagaacuuccacuuccacagcaagcgggucaccgcgcacggggacacgccccagcuggaccucaaggcccgccccaccuacggcgccggggagaucaccgugcugguggaggucgccgacauggagcugcacaccaagaagaucgagaucuccggccucaaguucgccagccuggcgugcacgggcugcuacgccugcagcuccagcaucuccugcaaggugcggauccacguggacgagccggacgagcugaccguccacgugaagagcgacgaccccgacguggucgccgccuccagcucccucauggcgcgcaagcuggaguucgggaccgacagcaccuucaaggccuucuccgccaugcccaagacgagccugugcuucuacaucguggagcgggagcacugcaaguccugcagcgaggaggacaccaagaagugcgugaacaccaagcucgagcagccccaguccauccugaucgagcacaagggcaccaucaucgggaagcagaacagcacgugcaccgccaaggccuccugcuggcuggagagcgucaaguccuucuucuacggccucaagaacaugcugagcgggaucuucggcaacguguucaugggcaucuuccuguuccucgcgccguucauccugcugauccucuucuucauguucggguggcgcauccuguucugcuucaagugcugccggcgcacccggggccuguucaaguaccgccaccucaaggacgacgaggagaccggguaccggcgcaucaucgagaagcugaacaacaagaagggcaagaacaagcugcucgacggggagcgccuggccgacggccggaucgccgagcuguucuccacgaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16988 - RNA, 1246 nt, Artificial Sequence
  mRNA product Design1 comprising derived and/or modified sequence from CCHVF(10200)__U39455.2__IgE-leader_Gn (opt1)
gggagaaagcuuaccauggacuggaccuggauccuguuccucguggccgccgcgacccgcguccacagcuccgaggagcccagcgacgacugcgugucccggacgcagcugcugcgcaccgagaccgccgagauccacggcgacaacuacgggggcccgggggacaagaucaccaucugcaacggcagcacgaucguggaccagcggcucggguccgagcugggcugcuacaccaucaaccgcguccggagcuucaagcugugcgagaacuccgccaccggcaagaacugcgagaucgacagcgugcccgugaagugccgccagggguacugccuccggaucacccaggagggccgcgggcacgucaagcugucccggggcagcgagguggugcuggacgccugcgacacguccugcgagaucaugauccccaaggggaccggcgacauccucgucgacugcagcggcgggcagcagcacuuccugaaggacaaccugaucgaccucggcugccccaagaucccgcugcuggggaagauggccaucuacaucugccgcauguccaaccaccccaagaccaccauggcguuccucuucugguucagcuucggcuacgugaucacgugcauccugugcaaggccaucuucuaccugcucaucaucgugggcacccuggggcggcgccugaagcaguaccgggagcucaagccccagaccugcaccaucugcgagacgacccccgucaacgccaucgacgccgagaugcacgaccugaacugcuccuacaacaucugcccguacugcgcgagccgccugaccuccgacggccucgcccggcacgugauccagugccccaagcgcaaggagaagguggaggagaccgagcuguaccugaaccucgagcggauccccugggucgugcgcaagcugcuccaggugagcgaguccacgggggucgcccugaagcggagcagcuggcugaucgugcugcucgugcuguucaccgucucccugagccccgugcaguccgccccgaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16989 - RNA, 2206 nt, Artificial Sequence
  mRNA product Design1 comprising derived and/or modified sequence from CCHVF(10200)__U39455.2__IgE-leader_Gc (opt1)
gggagaaagcuuaccauggacuggaccuggauccuguuccucguggccgccgcgacccgcguccacagcuuccuggacuccacggccaagggcaugaagaaccugcucaacagcaccucccuggagaccagccuguccaucgaggcccccuggggcgccaucaacgugcagagcaccuacaagccgacgguguccaccgccaacaucgcgcucagcugguccagcgucgagcaccgggggaacaagauccugguguccgggcgcagcgaguccaucaugaagcuggaggagcggaccggcaucagcugggaccucgggguggaggacgccuccgagagcaagcugcugaccgucuccgugauggaccucagccagauguacucccccguguucgaguaccugagcggcgaccgccaggucgaggaguggcccaaggccacgugcaccggcgacugccccgagcggugcgggugcaccagcuccacgugccugcacaaggaguggccgcacagccgcaacuggcggugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaccucccaggagcgccagugcagccucaucgaggcgggcacccgguucaaccugggccccgugaccaucacgcuguccgagccccgcaacauccagcagaagcucccgcccgagaucaucacccugcacccccggaucgaggagggguucuucgaccugaugcacgugcagaagguccucagcgccuccaccgugugcaagcugcagagcugcacccacggcgugcccggggaccugcaggucuaccacaucggcaaccuccugaagggcgacaaggugaacgggcaccugauccacaagaucgagccgcacuucaacacguccuggaugagcugggacggcugcgaccucgacuacuacugcaacaugggggacuggcccuccugcaccuacaccggcgugacccagcacaaccacgccagcuucgucaaccugcugaacaucgagacggacuacaccaagaacuuccacuuccacuccaagcgcgugaccgcccacggggacacgccccagcucgaccugaaggcccggcccaccuacggcgcgggcgagaucaccguccugguggagguggccgacauggagcuccacaccaagaagaucgagaucagcgggcugaaguucgccucccuggccugcaccggcugcuacgccugcagcuccagcaucuccugcaagguccgcauccacguggacgagccggacgagcucacggugcacgucaagagcgacgaccccgacgugguggcggccagcuccagccugauggcccggaagcuggaguucgggaccgacuccaccuucaaggccuucagcgccaugcccaagaccucccucugcuucuacaucgucgagcgcgagcacugcaagagcugcuccgaggaggacaccaagaagugcgugaacacgaagcuggagcagccccagagcauccugaucgagcacaagggcaccaucaucgggaagcagaacuccacgugcaccgcgaaggccagcugcuggcucgaguccgucaagagcuucuucuacggccugaagaacaugcuguccggcaucuucgggaacguguucaugggcaucuuccucuuccuggccccguucauccugcugauccucuucuucauguucggguggcggauccuguucugcuucaagugcugccgccggacccgcggccuguucaaguaccggcaccucaaggacgacgaggagaccggguaccgccgcaucaucgagaagcugaacaacaagaagggcaagaacaagcugcucgacggcgagcggcuggccgacgggcgcaucgccgagcuguucagcaccaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16990 - RNA, 1666 nt, Artificial Sequence
  mRNA product Design1 comprising derived and/or modified sequence from CCHFV(10200)__NC_005302.1/U88410.1__N (opt5)
gggagaaagcuuaccauggagaacaagaucgaagugaauaacaaagacgagaugaauagaugguucgaagaguuuaagaaaggcaacgggcuggucgauaccuucacaaauagcuacuccuuuugcgaaucuguucccaaccucgaccgguucguguuucagauggccagcgcuacggaugacgcccaaaaggauuccauuuaugcgucugcucugguggaggccaccaaauucugugccccuaucuacgagugcgcuugggucagcuccacaggaauugugaagaagggccuugaaugguuugagaaaaaugccgggaccaucaagucuugggacgaaagcuauacagagcugaaaguugaugugccgaagauugagcagcucaccggauaccagcaggcugcccugaaauggcgcaaggacaucggcuucagagucaacgcgaauacagccgcucuuuccaacaaggugcuggccgaauauaaaguucccggggagaucgugaugagcgucaaggaaaugcucucugauaugauucggcgcagaaaucugauccugaaccggggaggcgacgagaauccucgcggccccgugucccacgaacacguggauugguguagagaguuugucaaagggaaguacauuauggcuuucaacccucccuggggagacaucaauaaaagcggccggucugggauugcccucguugcgaccggacuggccaaacuugcugagacggaaggcaaagggaucuuugaugaggccaagaagaccguggaagcucugaacggauaucucgacaaacacaaggacgagguggaucgcgccuccgccgacagcaugauuacaaaccugcuuaaacauaucgcuaaggcgcaagaacuguacaaaaauucuuccgcccucagagcucagagcgcccagaucgauaccgccuucuccucuuacuauuggcuguacaaggcuggcgucacaccugagaccuuuccgacggugagccaguuccuguucgagcucggcaagcaaccccgggggacaaagaagaugaaaaaggcccugcuuuccaccccuaugaaauggggaaagaagcuguaugaacucuuugcggacgauagcuuccagcagaaccgcauuuacaugcaccccgcuguucugacagccggcagaaucucugagaugggggugugcuuuggaaccauuccugucgccaaucccgacgaugcugcccagggcuccgggcauaccaaaagcauccuuaaccugcggacaaauacggaaaccaacaauccgugugcuaagacaauugugaaacucuucgagguucaaaagaccggauuuaacauccaggacauggauaucguggccucugaacaucugcugcaccagagccucgucggcaaacaauccccuuuccagaaugcguauaacgugaagggcaaugccacaucugcuaacauuaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16991 - RNA, 1666 nt, Artificial Sequence
  mRNA product Design1 comprising derived and/or modified sequence from CCHFV(Turkey-Kelkit06)__GQ337053.1__N (opt5)
gggagaaagcuuaccauggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaagacucugggaccaucaagagcugggaugaaaauuaugccgagcugaaaguggacguuccgaagauugagcagcucgcuaacuaccagcaggccgcgcugaaguggagaaaagauaucggauuccgggugaaugccaacacagcugcccuuuccaauaagguccuggcugaauauaaagugcccggcgagaucguuaugagcgugaaggaaaugcucucugacaugauucgcagacggaaccugauccugaaucgcgggggagaugagaacccuagaggccccgucucccgggaacacguggaguggugucgcgaguuugugaaaggcaaguacauuauggccuucaauccucccuggggagacaucaacaaaagcgggagaucuggcauugcgcucgucgccaccgggcuggcuaaacuugccgaaacagagggaaagggcguuuuugaugaagcuaagaagaccguggaggcccugaacggguaucucgacaaacaucgggacgaaguggauaaggccuccgcugacagcaugaucacgaaucugccuaaacacauugcgaaggcccaagagcuuuacaagaacucuuccgcucugcgcgcccagggagcccagaucgauaccccguucagcuccuuuuacuggcucuauaaagcuggcgucacacccgagaccuucccuacaaucucucaguuccuguuugaacugggcgagcaacccagagggaccaagaaaaugaagaaagcccuccugagcacgccuaugaaguggggaaagaaacuuuacgaacuguucgcggacgauuccuuucagcagaaucggauuuauaugcaucccgcugugcucacagccggccgcaucagcgagauggggguuugcuucggaaccauuccgguggccaacccugacgaugcugcccagggcucugggcacacaaaguccauccugaaucuuagaaccagcaccgaaacaaacaaucccugugcuaaaacgauugucaagcuguuugagauccaagagaccggauucaacauccaggacauggauauuguggccucugaacaucuccugcaccagagcaucguuggcaaacaauccccuuuucagaaugcguacaacgugaagggcaaugccacaucugcuaacauuaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16992 - RNA, 5272 nt, Artificial Sequence
  mRNA product Design1 comprising derived and/or modified sequence from CCHFV(10200)__U39455.2__GP (opt5)
gggagaaagcuuaccaugcacaucagccugauguacgccauucucugccugcagcuuuguggccugggggagacccauggaucccacaacgaaacaagacauaauaagacggacaccaugacaacccacggcgauaaccccucuagcgagccuccgguguccacagcucucucuaucacccuggaccccagcacagucaccccuacgacccccgccuccgggcuugaaggaucuggcgagguuuauacaagcccucccauuaccacagggucccugccucucagcgaaaccacgccggagcugcccgugacaaccggaacagauacccugucugcgggcgacguggauccuuccacccagacagcuggcgggacgagcgcccccaccguccggacaucucucccuaauucccccagcaccccgucuacaccucaggacacccaucaccccgugcgcaaccugcuuuccguuacgagcccuggacccgaugagacauccacccccucuggcaccgggaaagaaagcuccgccacaagcucuccucacccgguguccaauagacccccuacacccccugcuaccgcccagggacccacggagaacgacagccauaaugcuaccgaacacccggagucucugacacagagcgccaccccuggccucaugacaucccccacccaaaucguccauccucagucugcgacgcccauuaccgugcaggauacacacccuagccccaccaaccgguccaagcgcaaucugaaaauggagaucauccuuacacugagccaggggcucaagaaauacuauggaaagauucugagacugcuccaacugacccuugaagaggacacggaaggccugcucgaguggugcaagcggaaccugggccuugauugugacgauacauucuuucagaaacgcaucgaagaguucuuuauuaccggggagggacacuucaaugaaguucugcaguuuagaacaccgggcacccucucuaccacagaguccacgccugccgggcugcccaccgcugaacccuucaagagcuacuuugccaaaggauuccugucuaucgacuccggcuauuacagcgcuaagugcuauuccgggacaucuaacagcggacuccagcugauuaauaucacccggcauuccacacgcauuguggacaccccuggcccgaaaaucacgaaccuuaagacaaucaauuguauuaaccugaaggccucuaucuuuaaagagcacagagaagucgagauuaacgugcuccugccccaaguggcggucaaucuuagcaacugccauguugugaucaagucccacgugugugauuacagccuggacauugauggcgccguccggcucccucauaucuaccacgaggggguguucauccccggaaccuauaaaauuguuaucgacaagaaaaauaagcugaacgaucgcugcacccuguuuacagacugugugauuaaaggcagagaaguccggaaggggcagucugugcuccgccaguacaagaccgagaucagaauuggaaaggcuuccacaggcuuccggagacugcuuagcgaggaaccuucugaugacugcguuucccgcacgcaacugcuccggaccgaaacagccgagauccacggggauaauuauggcggacccggcgacaagaucaccauuuguaacgggagcacaaucguggaucagagacugggaucugagcugggcugcuacaccauuaaucgcguccggagcuuuaaacuuugcgaaaacuccgcuacggggaagaauugugagaucgacagcgugccugucaaaugcagacagggauauugucuccgcauuacccaggaaggccgggggcaugugaagcugucuagaggcuccgagguugugcuggacgccugcgauacaagcugugagaucaugauucccaagggaaccggcgacauccucgucgauugcuccgggggacaacagcacuuccugaaagacaaccuuaucgaucugggcuguccgaagauuccucuccuggggaaaauggccaucuacauuugccgcaugucuaaucaucccaagacaaccauggcuuuccuguuuugguucagcuuuggauaugugaucacauguauucuuugcaaagcgaucuucuaccuccugaucauuguuggcacccuggggcggagacucaagcaguaccgcgaacugaagccucagacguguacaaucugcgagaccacccccgugaacgccauugacgcugaaaugcacgaucuuaauugcuccuauaacaucuguccguacugcgccucucggcugacaagcgacggccucgccagacacgucauucaauguccuaaacggaaggagaaaguggaagagaccgagcuguaucugaaucuugaacgcauccccugggugguuagaaagcuccugcaggucuccgagucuacgggaguggcucugaaacggagcuccuggcucaucgugcugcuuguccuguuuacagugagccucucuccuguucaguccgcccccauuggccaggggaagaccaucgaagcguacagagcucgcgagggauauacaagcauuugccuguucgugcugggcucuauccuuuuuauugucuccugucucaugaaggggcugguggauagcguuggaaacucuuucuuucccggccuguccaucugcaaaaccuguagcaucuccagcauuaacggguucgaaaucgagucucauaagugcuacuguagccucuuuugcuguccuuauugccggcacugcuccacagacaaagagauucauaagcugcaccuuucuaucuguaaaaagagaaaaaccggcagcaaugugaugcuggccgucugcaagcucauguguuuccgcgccacgauggaaguguccaacagagcucuguuuauucggucuaucauuaauaccacauucguucugugcauccuuauccuggccgugugugucgugagcaccuccgcuguggagauggaaaaccucccggccggaacaugggagcgcgaagaggaucugaccaauuucugccaucaagagugucaggucacggaaacagagugccucugucccuacgaagcgcugguucuuagaaagccucuguuucucgacucuaccgccaaaggcaugaagaaccugcugaauagcacaucccuugagaccagccugucuauugaggcucccuggggagccaucaacgugcaguccaccuacaaaccuacagugagcacggcuaauauugcccucucuugguccagcgucgaacaccggggaaacaagauccugguguccggccgcucugagagcauuaugaaacucgaagagagaaccgggaucuccugggaucugggaguugaagacgcgagcgagucuaaacuucugacaguguccgucauggaccucagccagauguauucucccguguucgaguaccugagcggcgaucggcaaguugaagaguggccuaaggcuaccugcacaggcgacuguccggaacgcugcgggugcaccuccucuacgugucugcacaaagaguggccccauagcagaaauuggcggugcaacccuacaugguguuggggagugggcaccgggugcaccuguugcggacuugaugucaaggaccuguuuacagauuauauguucgugaaauggaagguugaauacaucaaaaccgaggccauugugugugucgagcucacaucccaggaacgccagugcucucugaucgaggccggcacgagauuuaaucucgggcccgugaccauuacacugagcgaaccucggaacauccaacagaaacuucccccggagauuaucacccugcacccuagaaucgaagagggauucuuugaccugaugcaugugcagaagguccucuccgcuagcacaguuuguaaacugcagucuugcacccacggcgugcccggcgaucuucaaguguaucauauugggaaucugcucaagggagacaaagucaacggccaccugauccacaagauugagccccauuucaacacguccuggaugagcugggaugggugugaccucgauuacuauugcaauaugggagacuggccuuccugcaccuacacaggcgugacccagcacaaccaugccucuuuuguuaaucugcuuaacaucgaaacagauuacaccaaaaauuuccacuuucacagcaagcgcgugacagcccauggggacacgccccagcuggaccugaaggcucggccuaccuauggagcgggcgagauuacaguccucguggaaguugccgauauggagcugcacaccaaaaagaucgagauuuccggccuuaaauucgcuucucuggccuguaccgggugcuacgccuguagcuccagcaucucuugcaaggugagaauccaugucgacgaaccggaugagcucacagugcacgucaaauccgacgaucccgacgugguugcugccucuagcucccugauggcgcgcaagcucgaauuuggaacggauagcaccuucaaggcuuucucugccaugccuaagacaagccuguguuuuuauauuguggagcgggaacauugcaaguccuguucugaggaggacaccaaaaagugcgucaacacaaaacuugaacagccccaaagcauccugauugagcacaagggcaccaucauugggaaacaaaauuccacguguacagccaaggcuagcugcuggcuggaauccgugaagucuuucuuuuacggacucaaaaacaugcugagcggcaucuucgggaauguuuuuaugggaaucuuccuuuuucuggccccuuucauucuccugauccucuuuuucauguuuggcuggcgcauucuguucuguuucaagugcugcagacggaccagaggccuuuuuaaauaucgccaccugaaggaugacgaggaaaccggguaccggagaaucauugagaaacugaacaauaagaaggggaaaaacaagcuccuggauggcgagcggcuugcggacgggcgcaucgcugaacuguucuccacaaaaacccauaucggaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16993 - RNA, 5272 nt, Artificial Sequence
  mRNA product Design1 comprising derived and/or modified sequence from CCHFV(IbAr10200)__AF467768.2__GP (opt5)
gggagaaagcuuaccaugcacaucagccugauguacgccauucucugccugcagcuuuguggccugggggagacccauggaucccacaacgaaacaagacauaauaagacggacaccaugacaacccccggcgauaacccuucuagcgagccgcccguguccacagcucucucuaucacccuggacccuagcacagucacccccacgaccccugccuccgggcuugaaggaucuggcgagguuuauacaucucccccuauuaccacagggucccugccgcucagcgaaaccacgcccgagcugccugugacaaccggaacagauacccugucugcgggcgacguggaucccuccacccagacagcuggcgggacgagcgccccuaccguccggacaucucuccccaauuccccgagcaccccuucuacaccccaggacacccaccauccugugcgcaaccugcuuuccguuacgagccccggacccgaugagacauccaccccuucuggcaccgggaaagaaagcuccgccacaagcucuccgcaccccguguccaauagaccucccaccccucccgcuacagcccagggaccgacggagaacgacagccacaaugcuaccgaacauccugagucucugacacagagcgccacccccggccucaugacauccccuacccaaaucguccacccccagucugcgacgccuauuaccgugcaggauacacaucccagcccgaccaaccgguccaagcgcaaucugaaaauggagaucauccuuacacugagccaggggcucaagaaauacuauggaaagauucugagacugcuccaacugacccuugaagaggacacggaaggccugcucgaguggugcaagcggaaccugggccuugauugugacgauacauucuuucagaaacgcaucgaagaguucuuuauuaccggggagggacacuucaaugaaguucugcaguuuagaacaccuggcacccucucuaccacagaguccacgcccgccgggcugcccaccgcugaaccuuucaagagcuacuuugccaaaggauuccugucuaucgacuccggcuauuacagcgcuaagugcuauuccgggacaucuaacagcggacuccagcugauuaauaucacccggcacuccacacgcauuguggacaccccgggccccaaaaucacgaaccuuaagacaaucaauuguauuaaccugaaggccucuaucuuuaaagagcauagagaagucgagauuaacgugcuccugccucaaguggcggucaaucuuagcaacugccacguugugaucaagucccaugugugugauuacagccuggacauugauggcgccguccggcucccccacaucuaccaugaggggguguucaucccuggaaccuauaaaauuguuaucgacaagaaaaauaagcugaacgaucgcugcacccuguuuacagacugugugauuaaaggcagagaaguccggaaggggcagucugugcuccgccaguacaagaccgagaucagaauuggaaaggcuuccacaggcagccggagacugcuuucugaggaacccuccgaugacugcaucagccgcacgcaacugcuccggaccgaaacagccgagauccacggggauaauuauggcggaccuggcgacaaaauuaccaucuguaacgggucuacaauuguugaucagagacugggaagcgagcugggcugcuacaccaucaaucgcgugcgguccuucaaacuuugcgaaaacagcgcuacggggaagaauugugagauugacucuguccccgugaaaugcagacagggauauugucuccgcaucacccaggaaggccgggggcacgucaagcuguccagaggcagcgaggugguucuggacgccugcgauacauccugugagauuaugaucccgaagggaaccggcgacauccucguggauugcucugggggacaacagcauuuucugaaagacaaccuuauugaucugggcuguccuaagaucccccuccuggggaaaauggccauuuacaucugccgcaugagcaaucacccuaagacaaccauggcuuuccuguucugguuuuccuucggauaugucauuacauguauccuuugcaaagcgaucuuuuaccuccugauuaucgugggcacccuggggaagcggcucaagcaguacagagaacugaaaccccagacguguacaauuugcgagaccaccccgguuaacgccaucgacgcugaaaugcaugaucuuaauugcucuuauaacauuuguccuuacugcgccagccgccugacauccgacggccucgcccggcacgugauccaaugucccaagagaaaagagaaggucgaagagaccgagcuguaucugaaucuugaacggaucccuuggguggugcgcaaacuccugcagguuucugagagcacgggagucgcucugaagagauccagcuggcucauugugcugcuugugcuguucacagucucucucucccccgugcagagcgcccccaucggccaggggaagaccauugaagcguaccgggcuagagagggauauacaucuaucugccuguuuguucugggcuccauucuuuucaucgugagcugucucaugaaagggcuggucgauucugugggaaacuccuuuuucccuggccugagcaucugcaagaccuguuccauuagcucuaucaacggguuugaaauugagagccacaaaugcuacuguucccucuucugcuguccguauugccgccauugcucuacagacaaggagauccacaaacugcaucuuagcauuuguaagaaacggaagaagggcuccaauguuaugcuggccgugugcaaacucauguguuuuagagccaccauggaagucucuaaccgcgcucuguucaucagaagcauuaucaauacgaccuuugugcugugcauccuuauucuggccguuuguguggucuccacaucugcuguggagauggaaaaccuccccgccggaaccugggagcgggaagaggaucugacaaauuucugccaccaagagugucaggugaccgaaacggagugccucuguccuuacgaagcgcugguccuucgcaagccccuguuccucgacagcacagccaaaggcaugaagaaccugcuuaauuccaccagccuggagacaucucuguccaucgaggcuccuuggggagccauuaacguucagagcaccuacaaacccaccgugucuacagcuaauaucgcccucuccuggagcuccguggaacauagagggaacaagauucuggucucuggccggagcgaguccaucaugaagcucgaggaacgcacggggaucagcugggaucugggaguggaagacgcgucugaguccaaacuucugaccguuagcgugauggaccucucucagauguauagcccugucuuugaguaccuguccggcgauagacaagugggcgaauggccgaaggccacaugcaccggggacugucccgagcggugcggaugcacaucuagcaccugucugcacaaagaauggccucacucccgcaauuggagaugcaaccccacgugguguuggggcguugggacaggaugcaccuguugcggccuugaugugaaggaccuguucaccgauuauauguuugucaaauggaagguggaguacauuaagacagaagcuaucguuuguguggagcucaccucucaggagcggcagugcagccugauugaagccgggacacgcuucaaucucggaccugucacgaucacccuguccgagcccagaaacauucaacagaaacuuccgccugaaaucaucacacugcauccccggauugaggaaggcuuuuucgaccugaugcacgugcagaaggugcucagcgcuucuaccgucuguaaacugcaguccugcacacauggcguucccggggaucuucaaguguaucacaucggaaaucugcucaagggcgacaaagugaacgggcaucugauucacaagaucgagccucacuuuaacaccagcuggauguccugggauggaugugaccucgauuacuauugcaauaugggcgacuggcccucuugcacguacaccggggucacacagcauaaccacgccagcuucgugaaucugcuuaacauugagaccgauuacacaaagaauuuucauuuccacuccaaaagaguuaccgcccacggagacacaccucagcuggaccugaaggcucgcccgacguauggcgcgggcgaaaucaccgugcucgucgagguggccgauauggaacugcauaccaaaaagauugagaucucugggcuuaaauuugcuagccuggccuguacaggaugcuacgccuguuccagcggcaucucuugcaagguucggauucacguggacgagcccgaugaacucaccguccaugugaaauccgacgauccugacgucguggcugccucuagcucccugauggcgagaaagcucgaguucgggacagauagcacguuuaaggcuuucucugccaugcccaaaaccagccuguguuucuauaucguugaacgcgagcacugcaaguccuguucugaagaggacaccaaaaagugcgugaacacaaaacuugagcagccucaaagcauucugaucgaacauaagggaacaauuaucggcaagcaaaauuccaccuguacggccaaagcuagcugcuggcuggaguccgucaagagcuuuuucuacgggcucaaaaacaugcugagcggaaucuuuggcaauguguucaugggcauuuuucuuuuccuggcccccuuuauccuccugauucucuucuuuauguucggguggcggauccuguuuuguuucaagugcugcagacgcacacggggacuuuucaaauauagacaccugaaggaugacgaagagaccggcuaccgccggauuaucgaaaagcugaacaauaaaaaggggaaaaacaagcuccuggauggagagagacuugcggaccggcgcaucgcugagcuguuuuccaccaaaacacacauuggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16994 - RNA, 5284 nt, Artificial Sequence
  mRNA product Design1 comprising derived and/or modified sequence from CCHFV(Turkey-Kelkit06)__GQ337054.1__GP (opt5)
gggagaaagcuuaccaugcccaccaacaucaugcacacaccucuggugugcuucauucucuaccugcagcuucugugucucggcggggcccauggacaacugaaugcuacggagcacaacggcaccaauaacacaaccgccccgggggcgagccagucccccaagccucccaugucuacaaccccuccccaugcuccugaaagcuccacaaucaaaccgaccacgcccauuucugaggccgaaggaagcggcgagaccacauccccucccaauaccacacaggggcuuucuagcccugaaaccacguccgagagacccgccacaaccagcaucucuacauccagcaccgacucuaccaacccgacaacgcagaugaccgauaauacaccuacccccacagucuccaccagcccuucuuccagccccuccacgcccucuacaccucaagggauucaccauccggcucggagccugcucuccguuagcucucccaagaccgugaccacaccuacccccacauccccuggcgagaugagcucugaaacgagcucccagcacucugccaugagccgcauccccaccccgcacacagcuaccagaguguccacagagaucaccaaccaucggacgccucgccagagcgaaucuuccgcccagcaaaccacacccagcccuaugaccucucccgcgcaguccauucugcugaugagcgccgcuccuacagccguccaggacauccaccccuccccgaccaauagaucuaaacggaaccucgagacggagauuauccugacacuuagccagggccugaagaaauauuacgggaagauucucaagcugcuucaucugacccucgaacaagauacagagggacugcuggaauggugcaaaggcaaucucggguccaacugugacgaugacuuuuuccagaagcgcaucgaggaauuuuucaugaccggagagugcuauuuuaaugaggugcugcaguucaaaacccuuucuacacugagcccuacggaacccucccacgcuagacuccccaccgccgagccuuuuaagagcuacuucgcgaaaggcuuucugucuauugauuccggguauuucagcgccaaguguuacccgcggucuuccgcuagcggacuucaacugaucaacguuacacagcaccccgcccgcaucgcugaaaccccuggccccaagacaaccucucucaaaacgauuaauugcaucaaccugagagccagcguguuuaaggagcaucgggaagucgagauuaacgugcugcucccucagaucgccguuaaucuguccaacugucacguggucauuaauagccaugugugcgacuauucucuugauacagacggccccgugcgccugccuagaaucuaccacgaggggaccuucauccccggaaccuacaaaauugucaucgauaagaaaaacaagcucaaugaccgguguacacugguuaccaacugcgugauuaaaggccgcgaagugagaaaggggcaguccguccuucggcaauauaagacagagaucaaaauuggaaaggcuagcacgggcuuuagaaaacugcucuccgaggaaccgggggaugacuguaucucucgcacccagcugcugcggacagaaaccgcggagauccaugacgauaauuacggaggcccuggcgacaagauuacaaucugcaacgggagcaccauuguggaucagagacucggauccgagcugggcugcuauacgaucaaucgcguuaaaucuuucaaacuuuguaagaacagcgccaccgggaagacaugcgaaguggacuccacccccgucaagugucggcagggauucugccugaaaauuacacaagagggcagagggcacgugaagcucucucgcggcagcgaaguugugcuggaugcuugugacuccagcugcgaggucaugaucccuaaaggaaccggcgauauucugguggacuguucugggggacagcagcacuuucuuaaggauaaucucaucgaccugggcugcccccauaucccgcugcucgggcggauggccauuuacaucuguagaauguccaaccacccucgcacaaccauggccuuccuguuuugguucagcuuuggauaugucauuacgugcaucuucuguaaggcucuguuuuacucucugauuaucaucggcacacucgggaaaaagauuaaacaguaucgggagcugaagccccaaaccugcaccaucugcgaaacagccccugugaaugcgauugaugcugagaugcaugaccugaacuguuccuacaauaucugccccuacugugccagcagacuuaccucugacggccucgcccgccacguuacgcagugccccaaacggaaggaaaagguggaggaaacagagcuguaucugaaccucgagcggauuccuuggaucgucagaaaacugcuucagguguccgaaagcaccggaguugcucugaagcgcuccagcuggcucaucgugcugcugguccuucucacagugucucugagcccggugcaguccgcccccguuggccacgggaaaaccauugagaucuaccaaacaagagaaggauucgcuucuauuugucuguuuaugcucggcagcauccuguucauugucuccugccuugugaaggggcugguggauucugucagcgaguccuuuuucccuggacucucuguguguaaaaccugcagcaucggcuccguuaacggguuugaaaucgagagccauaaguguuauugcucucuguucuguugccccuacugccggcacuguuccgccgacagagagauucaucagcugcaccuuagcaucugcaaaaagcgcaagacgggcucuaaugugaugcucgcggucuguaaacggaugugcuucagagccaccauugaggcuucccgcagagcccugcugauccggagcauuaucaacacaaccuuugugauuuguauccucacacugaccaucugcguuguguccacgucugcugucgaaauggaaaaucuuccugccggaacaugggagcgcgaagaggaucugaccaacuucugucaucaggagugccaagugacagaaaccgagugucucugccccuaugaagcgcugguucugagaaagccucuuuuucuggacagcauugugaaaggcaugaagaaucuccugaacuccaccagccucgagacaucucuguccaucgaggccccguggggagcuauuaauguccagagcacguucaaacccaccgugucuacagccaacaucgcucuuagcugguccucugugguccaccggggaaauaagauucugguuaccggccgcagcgaauccaucaugaagcucgaggaaagaacaggggugucuugggaucugggaguggaggacgccagcgaauccaaacugcuuaccgucagcaucauggaucugucucagauguacuccccuguguuugaguaucucagcggcgaccggcagguugaggaauggcccaaggccacguguacaggggauugcccugagcgcugcggcuguaccuccucuaccugccugcacaaagaauggagccauuccagaaacuggcgguguaaucccacauggugcuggggagugggcaccggguguacaugcuguggagucgacgugaaggaucucuucacggaccacauguuuguuaaauggaagguggaguacauuaagaccgaagcuaucgucugcguggcgcugacaucucaagagcgccaguguagccuuauugaggccggcaccagauucaaccuggggccgguuacaaucacccucuccgaaccucggaauauucagcagaaacugccucccgagaucaucacgcugcaucccaagauugaagagggauuuuucgaucuuaugcacgugcaaaaaguccugagcgcuucuaccgugugcaagcuccaguccuguacacauggcauccccggcgaccuucagguguaccacauugggaaccuccugaaaggagacagagucaauggccaccuuauccauaagauugaaagccacuuuaacaccucuuggauguccugggaugggugcgaccuggauuauuacugcaacaugggagacuggccuagcuguacauauaccggcguuacacagcauaaucacgccgccuucgugaaccugcucaauaucgagacggauuacaccaagacauuucacuuccauucuaaacgcgugaccgcucacggggacaccccgcaacuggaucuuaaggcccggcccacauauggagcgggcggcauuacgguccugguggagguugcugacauggaacuccauaccaaaaagguggagaucagcgggcugaaauucgccucccucgccugcacaggauguuacgcuugcucuagcggcaucuccuguaagguccgcauucacguggaugaaccugacgagcugaccguucaugugaaaagcuccgaucccgacgucguggccgcgucuacaagccuuauggcuagaaagcuggaguuugggaccgauuccacguucaaggccuuuucugccaugccuaaaacaagccugugcuucuauaucgucgaacgggaguacuguaaguccugcucugaagacgacacccagaaauguguggauaccagacucgagcagccccaaagcauucugaucgaacacaagggaacaauuaucggcaaacagaacgauaccugcacagcuaaggccuccuguuggcuugagagcguuaaguccuuuuucuacgggcugaaaaauaugcucggaucuguguuuggcaaccuguucaucggcauucuccuguuucuugcuccguucguccugcuggugcucuuuuucauguucggguggaagauccuguuuugcuucaaaugcugucgccggaccagaggacuuuuuaaguaucgccaccugaaagacgacgaggaaacgggcuaccggagaauuaucgagcggcucaauagcaagaaggggaaaaaccgccugcucgauggagacagacuggccgaucggaagauugcggaacuuuucucuacaaaaacccauaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16995 - RNA, 3796 nt, Artificial Sequence
  mRNA product Design1 comprising derived and/or modified sequence from CCHVF(10200)__U39455.2__SP-GP_Gn-NSm-Gc (opt5)
gggagaaagcuuaccaugcacaucagccugauguacgccauucucugccugcagcuuuguggccugggggagacccauggaucccacaacgaaacaucugaggaacccagcgacgauugcguguccagaacgcagcuccugcggaccgagacagcugaaauccauggcgacaauuaugggggaccuggcgauaagauuaccaucuguaacgggucuacaauugucgaccagcgccuuggaagcgagcugggcugcuacaccaucaauagaguucgguccuucaaacucugugagaacucugccacaggcaagaauugcgaaaucgauagcgugccggugaaaugucgccagggguauugccugagaauuacccaggagggacggggccacgucaagcugucccgcgggagcgaagugguucucgacgcgugugauacgucuugcgagaucaugauucccaaaggaaccggcgacauccugguggauuguuccgggggacaacagcauuuucuuaaggacaaccugauugaucucggcugcccuaagaucccccugcuuggcaaaauggcuauuuacaucugcagaaugagcaaucacccuaagacaaccauggccuuccuguuuugguucucuuuuggguaugucaucacauguauucucugcaaagccaucuucuaccugcugauuaucgugggaacccucggccggcgccugaagcaguauagagagcuuaaaccccagacguguacaauuugcgaaaccacaccuguuaacgcuaucgacgccgagaugcacgaucugaauuguuccuacaacaucugcccguacugugcuagccggcucaccucugacgggcuggcccgccaugugauucaaugccccaagagaaaggaaaaagucgaggaaaccgagcuuuaucugaaucucgagcggaucccuuggguggugcgcaagcugcugcaggucuccgaaagcacaggaguugcgcucaaaagauccucuuggcugauugugcuucuggugcucuuuacggucagccugucccccgugcagagcgccccuaucggccaggggaagaccauugaggcuuaccgggccagagaaggauauacaucuaucugucuuuucguucugggcuccauccucuuuauugugagcugccugaugaaaggccuggucgacucuguggggaacagcuucuuucccggacucuccaucuguaagaccugcucuauuagcuccaucaauggcuucgagauugaaagccacaaaugcuacuguucucuguuuugcuguccguauugccgccauuguuccacagauaaggagauccacaagcuccaccugagcauuugcaaaaagcggaaaaccgggucuaacguuaugcucgcuguguguaagcugaugugcuucagagccacgauggaggucuccaaucgcgcgcuguucauccggagcaucauuaacacaaccuuugugcuuuguauccucauucuggccgucugcgugguuuccaccucugcuguggaaauggagaaccugccugccggaacaugggaaagagaggaagaccucaccaauuucugucaucaagagugccaggucacagagacggaaugccugugucccuacgaggcucuugugcugcgcaaaccucucuuucuggauagcaccgccaagggcaugaagaaccugcuuaauuccacaucucucgaaaccagccuguccaucgaggcccccuggggcgcuauuaacguucagagcacauauaaacccaccgugucuacggcgaauaucgcccuguccuggagcucugucgagcaccgggggaacaagauccucguguccggaagaagcgaaucuauuaugaaacuggaggaacgcaccggcaucagcugggaccuugggguggaggaugcuuccgaaagcaagcugcucacaguuucugucauggaccugucccaaauguacagcccuguguucgaguaccuguccggagauagacagguggaggaauggccgaaagcuaccugcacaggcgacugucccgagcggugcggguguaccucuagcacgugccuucauaaggaauggccucacucccgcaauuggcgguguaaccccacauggugcuggggagucggcaccggguguacaugcuguggccucgaugugaaggaccuguuuaccgauuauauguucguuaaauggaagguggaguacauuaaaaccgaagccaucgucugcguggagcugacaucucaggagagacagugcagccucauugaagccggaacgcgguuuaaucugggcccuguuaccaucacacuuuccgagccccgcaacauccaacagaagcugccgccugaaauuaucacccuccaucccagaauugaggaaggguucuuugaccugaugcacgugcagaaaguccugucugccagcacaguguguaaacuucaguccugcacccacggaguuccuggcgaccuccaaguguaucauaucgggaaucugcugaagggagauaaagucaacggccaccucauucauaagaucgagccccacuucaauacgagcuggaugucuugggacgggugugaucuggacuacuauugcaacaugggcgauuggccuuccuguacauacaccggagugacccagcacaaucaugcgagcuuugugaaccuucugaacaucgagacagacuauaccaaaaauuuccacuuucauucuaagcgggucacagcucacggcgauacgccccagcucgaccugaaagccagaccgaccuacggggccggagaaauuacaguucugguggagguggcugauauggaacuucauaccaagaaaaucgagauuuccggccugaaguucgccagccucgcuugcacaggguguuacgccuguucuuccagcaucuccugcaagguccgcauucacguggacgagccugaugaacugaccguucacgugaaaagcgacgaucccgacgucguggcggccucuagcucccucauggcucggaagcuggaguucggaacggacucuaccuuuaaagccuucagcgcuaugcccaagacaucccuuugcuuuuauaucguugaaagagagcauuguaaaucuugcagcgaagaggauaccaagaagugcgugaacacaaaacuggagcagccucaauccauucucaucgaacacaagggcaccaucauugggaaacaaaauucuacauguaccgccaaggcgagcugcuggcuggaguccgucaagagcuucuuuuacggccugaagaacaugcuuucuggaaucuucggcaauguguuuauggggauuuuccuguuucucgccccguucauccugcucauucuguuuuucauguuuggauggcgcauccuuuucuguuucaagugcuguagacggacgcgcggccuguuuaaauauagacaucucaaggacgaugaagagacaggguaccggcgcaucauugaaaaacugaacaauaagaaaggaaagaacaagcugcuugacggcgagagacuggcugauggccggaucgccgagcuuuucuccaccaaaacccacauugggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16996 - RNA, 3769 nt, Artificial Sequence
  mRNA product Design1 comprising derived and/or modified sequence from CCHVF(10200)__U39455.2__IgE-leader_Gn-NSm-Gc (opt5)
gggagaaagcuuaccauggacuggaccuggauccuguuccucguggccgcugccacaagaguccacagcuccgaggaacccucugaugacugcguuagccggacgcagcugcuucgcaccgagacagcggaaauucauggcgauaacuacgggggaccuggcgacaagaucaccauuuguaauggguccacaaucguggaucaaagacugggaucugagcucggcugcuauaccauuaaccgggugcgcagcuuuaaacugugugaaaauuccgcuacagggaagaacugcgagaucgacucugucccggugaaauguagacagggauacugccuucggaucacccaggagggccgcggccacguuaagcugagcagaggguccgaagugguccucgaugccugugacacgagcugcgagauuaugauccccaaaggaaccggcgauauucugguggacuguucugggggacagcaacauuuccugaaggauaaucucaucgaccugggcugcccuaagauuccccuucuggggaaaauggccaucuauauuugucggauguccaaccacccuaagacaaccauggcuuuucucuucugguuuagcuucggauacguuaucacaugcauccugugcaaagccaucuuuuaucuucugauuauugugggcacccucggccgcagacugaagcaguaccgggaacugaaaccccagacguguacaaucugcgagaccacaccugucaaugcuauugaugccgagaugcaugaccucaacuguucuuauaauaucugcccguacugugcgucccgccugaccagcgacgggcuugccagacacgugauccagugccccaagcggaaggaaaaaguggaggaaaccgagcuguaccucaaccuggaacgcauuccuugggucguuagaaagcugcugcaagugucugaguccacaggaguggcucucaaacggagcuccuggcugaucguccugcucgugcuguucacgguuucucuuagccccgugcaguccgccccuauuggccaggggaagaccaucgaggcuuauagagcccgcgaaggauacacaagcauuugucuguuuguccucggcucuauccuguucaucguguccugccuuaugaaagggcugguugauagcgugggaaauucuuucuuucccggccucagcauuuguaagaccugcuccaucucuagcauuaacggcuuugagaucgaaucccacaaauguuauugcagccuguucugcuguccguacugccggcauuguucuacagacaaggagauucacaagcugcaucucuccaucugcaaaaagagaaaaaccgggagcaaugucaugcuggcgguguguaaacuuaugugcuuccgcgccacgauggaagucucuaaccgggcucuguuuauuagauccaucaucaauacaaccuucgugcucuguauucugauccuggccguuugcguggucagcaccuccgcuguggagauggagaaccuuccugccggaacaugggaacgcgaggaagaucucaccaacuuuugucaccaggagugccaaguuacagaaacggagugucugugccccuaugaggcccuggugcuccggaagccucuguuccuugacucuaccgcuaagggcaugaagaaucugcucaacagcacaucccuggaaaccucucugagcauugaggcgcccuggggagccaucaauguccaguccacauacaaacccaccgugagcacggcuaacauugcccuuucuugguccagcguggaacacagagggaauaagauccucguuucuggccgcuccgagagcaucaugaaacuggaggaacggaccgggauuucuugggaucugggcgucgaggacgccagcgaauccaagcuccugacagugagcgugauggaucuuucucagauguauuccccugucuuugaguaccugagcggagacagacaaguggaagaguggccgaaagcuaccugcacaggcgauugucccgagcgcugcggguguaccuccucuacgugccuccauaaggaauggccucacagccggaacuggagauguaaucccacauggugcuggggaguuggcaccggguguacaugcuguggacuggacgugaaggaucuguucaccgacuacauguuugucaaauggaagguggaguauaucaaaaccgaagccauuguuugcguggagcuuacaucccaggaacggcaguguucucucaucgaggcgggcacgcgcuucaaccuggggccugucaccauuacacugagcgagcccagaaauauccagcaaaagcucccgccugaaaucauuacccugcauccccggaucgaggaaggcuuuuucgaccuuaugcacgugcagaaaguucuguccgcuucuacagugugcaagcuccagagcugcacccauggagucccuggcgaucuucagguguaccacauugggaaccugcuuaagggagacaaagugaauggccaccucauccauaagauugagccccacuuuaacacguccuggaugagcugggaugggugugaccuggauuauuacugcaauaugggagacuggccuucuuguacauauaccggcgucacccaacauaaccacgccuccuucguuaaucugcucaacaucgaaacagauuacaccaaaaacuuucacuuccauagcaagagagugacagcccacggggacacgccccagcuggaucuuaaagcucgcccgaccuauggcgccggagagaucacagugcuggucgagguggcugacauggaacuccauaccaagaaaauugagaucucuggccugaaguucgccucccuggcgugcacaggguguuacgccugcucuagcuccauuagcuguaagguucggauccacguggaugaaccugacgagcuuaccguccaugugaaauccgaugaccccgacguuguggcugccagcucuagccugauggcuagaaagcucgaguuuggaacggauuccaccuucaaagccuuuucugcgaugcccaagacaagccugugcuucuacauugucgaacgcgagcacuguaaauccugcucugaagaggacaccaagaagugugugaauacaaaacucgaacagccucagagcauccugauugagcacaagggcaccaucaucgggaaacaaaacuccacaugcaccgccaaggcuucuugcuggcuugagagcguuaaauccuuuuucuauggacugaagaauaugcucagcggcauuuuugggaacguguucaugggcaucuuucuguuccuggccccguuuauucuucugauccucuucuuuauguucggauggcggauucuguucuguuuuaagugcuguagacgcacgagaggccucuucaaauaccggcaucugaaggaugacgaagagacaggguaucgcagaaucaucgaaaaacuuaauaacaagaaaggaaagaauaagcugcucgauggcgagcggcuggcugacgggcgcauugccgaacuguuuucuaccaaaacccacaucggaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16997 - RNA, 3190 nt, Artificial Sequence
  mRNA product Design1 comprising derived and/or modified sequence from CCHVF(10200)__U39455.2__IgE-leader_Gn-4aa-Gc (opt5)
gggagaaagcuuaccauggacuggaccuggauccuguuccucguggccgcugccacaagaguccacagcuccgaggaacccucugaugacugcguuagccggacgcagcugcuucgcaccgagacagcggaaauucauggcgauaacuacgggggaccuggcgacaagaucaccauuuguaauggguccacaaucguggaucaaagacugggaucugagcucggcugcuauaccauuaaccgggugcgcagcuuuaaacugugugaaaauuccgcuacagggaagaacugcgagaucgacucugucccggugaaauguagacagggauacugccuucggaucacccaggagggccgcggccacguuaagcugagcagaggguccgaagugguccucgaugccugugacacgagcugcgagauuaugauccccaaaggaaccggcgauauucugguggacuguucugggggacagcaacauuuccugaaggauaaucucaucgaccugggcugcccuaagauuccccuucuggggaaaauggccaucuauauuugucggauguccaaccacccuaagacaaccauggcuuuucucuucugguuuagcuucggauacguuaucacaugcauccugugcaaagccaucuuuuaucuucugauuauugugggcacccucggccgcagacugaagcaguaccgggaacugaaaccccagacguguacaaucugcgagaccacaccugucaaugcuauugaugccgagaugcaugaccucaacuguucuuauaauaucugcccguacugugcgucccgccugaccagcgacgggcuugccagacacgugauccagugccccaagcggaaggaaaaaguggaggaaaccgagcuguaccucaaccuggaacgcauuccuugggucguuagaaaacuucugcaagugucugaguccacaggaguggcucucaagcggagcuccuggcugaucguccugcucgugcuguucacgguuucucuuagccccgugcaguccgccccuauuggcagaaagccccuguuucucgauagcaccgcuaaagggaugaagaaucugcuuaacucuacaucccuggagaccagccucucuaucgaagccccguggggagcgauuaauguccagagcacauauaaaccuaccguguccacggccaacaucgcucugucuuggagcuccguugagcaccgcggcaauaagauccuggugagcgggcggucugaauccauuaugaagcucgaggaaagaacaggaaucagcugggaccugggcgucgaggaugccucugaguccaaacuucugaccgugagcgucauggaccucucccagauguacucucccguguucgaauaucugagcggcgaucgccaaguugaggaauggccuaaggcuaccuguacaggggacugccccgagcgguguggaugcaccuccucuacaugucugcauaaagaauggccccacagcagaaacuggcgcugcaacccuacguggugcuggggcguggggaccggauguacaugcuguggccuugaugucaaggaccucuuuaccgauuacauguucgugaaauggaagguugaguauauuaagacagaggccaucgugugcgucgaacugaccucccaggagcggcaguguagccugauugaagccgggacgagauuuaaucucggcccggugaccaucacacugucugagccccgcaacauucaacagaaacuuccucccgagaucaucacccugcauccucggauugaagagggauucuucgaccucaugcacgugcagaagguucuguccgcuagcacagucugcaaacugcagucuuguacccacggcgugcccggggaucuucaaguguaccauaucggaaaucuccugaagggcgacaaagucaacgggcaccugauucauaagaucgaaccgcacuuuaauacguccuggaugagcugggacggaugcgaucucgacuauuacuguaacaugggcgauuggccuucuugcacauacaccggggugacacagcauaaucacgcgagcuucguuaaccugcuuaauauugagaccgacuauaccaagaacuuucacuuccauuccaaaagagugacagcccacggcgauacgccccagcuggaccucaaggcucgcccuaccuacggagccggcgaaaucacaguccugguggagguugccgauauggagcugcauaccaaaaagaucgaaauuagcgggcuuaaauuugcuucucucgccuguacaggaugcuaugcgugcuccagcuccaucucuuguaaggugcggauucacgucgacgagcccgaugaacugaccgugcacguuaagagcgacgauccugacguggucgcugccuccucuagccugauggccagaaaacucgaguucggcacggauuccacauuuaaggcuuucucugccaugcccaaaaccagccugugcuuuuacaucguggaacgggagcauuguaaguccugcagcgaggaagacaccaaaaagugugugaauacaaaacuugagcagccgcaaucuauucugaucgaacacaaggggaccaucauuggaaagcagaacuccacaugcacggcuaaagccagcuguuggcucgagucugucaaguccuucuuuuauggccugaaaaauaugcugagcgggaucuucggcaacguuuuuaugggaauuuuccuuuuccucgcgccuuuuauccugcugauucucuucuuuauguucggcuggcgcauccuguuuugcuucaaguguugcagacggaccagagggcuuuuuaaauaccgccaucugaaggacgaugaagagacaggauaucggagaaucauugagaagcucaauaacaaaaagggcaaaaacaagcugcuggacggggaacgccuugccgauggaagaaucgcugagcuguucucuaccaaaacacacauuggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16998 - RNA, 1246 nt, Artificial Sequence
  mRNA product Design1 comprising derived and/or modified sequence from CCHVF(10200)__U39455.2__IgE-leader_Gn (opt5)
gggagaaagcuuaccauggacuggaccuggauccuguuccucguggccgcugccacaagaguccacagcuccgaggaacccucugaugacugcguuagccggacgcagcugcuucgcaccgagacagcggaaauucauggcgauaacuacgggggaccuggcgacaagaucaccauuuguaauggguccacaaucguggaucaaagacugggaucugagcucggcugcuauaccauuaaccgggugcgcagcuuuaaacugugugaaaauuccgcuacagggaagaacugcgagaucgacucugucccggugaaauguagacagggauacugccuucggaucacccaggagggccgcggccacguuaagcugagcagaggguccgaagugguccucgaugccugugacacgagcugcgagauuaugauccccaaaggaaccggcgauauucugguggacuguucugggggacagcaacauuuccugaaggauaaucucaucgaccugggcugcccuaagauuccccuucuggggaaaauggccaucuauauuugucggauguccaaccacccuaagacaaccauggcuuuucucuucugguuuagcuucggauacguuaucacaugcauccugugcaaagccaucuuuuaucuucugauuauugugggcacccucggccgcagacugaagcaguaccgggaacugaaaccccagacguguacaaucugcgagaccacaccugucaaugcuauugaugccgagaugcaugaccucaacuguucuuauaauaucugcccguacugugcgucccgccugaccagcgacgggcuugccagacacgugauccagugccccaagcggaaggaaaaaguggaggaaaccgagcuguaccucaaccuggaacgcauuccuugggucguuagaaaacuucugcaagugucugaguccacaggaguggcucucaagcggagcuccuggcugaucguccugcucgugcuguucacgguuucucuuagccccgugcaguccgccccuauuggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16999 - RNA, 2206 nt, Artificial Sequence
  mRNA product Design1 comprising derived and/or modified sequence from CCHVF(10200)__U39455.2__IgE-leader_Gc (opt5)
gggagaaagcuuaccauggacuggaccuggauccuguuccucguggccgcugccacaagaguccacagcuuucuggauuccacggcgaagggcaugaaaaaccuucucaauucuaccagccuggagacaucccugucuauugaagcucccuggggagccaucaacguucagagcaccuacaagccuacaguguccaccgccaauauugcucuuucuuggagcuccguggagcaucgggggaacaaaauccuggucagcggccgcucugaauccauuaugaagcucgaggaaagaacagggaucagcugggaccugggaguggaggaugccucugaguccaaacugcucaccguuagcgugauggaccugucucaaauguauuccccggucuucgaauaccuuagcggcgaucgccagguggaggaauggcccaaggcuacgugcaccggggacuguccugagcggugcggauguacauccucuaccugccugcacaaggaguggccccauagcagaaauuggcgguguaacccuacauggugcuggggcguuggcaccggguguacgugcuguggacucgaugugaaagaccuguuuacagauuauauguucgucaaguggaaaguggaauacaucaagaccgaggccauugugugcgucgaacuuacaucccaggagcgccaguguagccugaucgaagcgggcaccagauuuaaucucgggcccguuaccauuacacugucugagccucggaacauccaacagaaacugccgcccgagauuaucacgcuccacccucgcauugaagagggauucuuugaccugaugcaugugcagaaggugcuuuccgccagcaccgucugcaagcugcagucuugcacacacggcgugcccggggaucuccaaguuuaucacaucggaaaucugcuuaaaggcgacaaggugaacggccaucugauccacaaaauugaaccucauuucaauaccagcuggauguccugggaugggugugaccucgacuacuauugcaacaugggagauuggcccucuuguacauacaccggcgucacgcagcacaaucacgcuagcuuugugaaccugcugaauaucgagacagacuacaccaagaacuuccauuuucacuccaaaagaguuaccgcccauggggauacaccgcagcucgaccugaaggcucggccuaccuauggagccggcgaaauuacagugcuugucgagguggcggauauggagcugcacacgaaaaagaucgaaauuagcgggcucaaguucgccucucuggcuugcaccggauguuacgccugcuccagcucuaucuccuguaaaguccgcauccauguggacgagcccgaugaacuuacaguucacgugaaguccgacgauccugacgucguggcugccuccucuagccugauggccagaaaacucgaguuuggcaccgauuccacauucaaggcuuucucugcgaugcccaaaaccagccugugcuuuuauauuguugaacgggagcacuguaaguccugcagcgaggaagacacgaagaaaugugugaacaccaagcuggagcagccccaaucuauccucauugaacauaaaggcacaaucauugggaagcagaauagcacaugcaccgccaaagcuagcugcuggcuggagucugucaaguccuucuuuuacggacuuaagaacaugcugagcggcaucuucgggaauguguuuaugggaaucuuccucuuucuggccccuuucauucugcuuauccucuuuuucauguuuggcuggcgcauucuguucuguuuuaaaugcuguagacggaccagagggcuguucaaguaucgccaccucaaagacgaugaggaaacgggcuaccggagaaucauugagaagcugaacaauaaaaagggaaagaacaaacuucuggacggcgaacgccucgccgaugggcggaucgcugagcuguucucuacaaagacccauauuggaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17000 - RNA, 1666 nt, Artificial Sequence
  mRNA product Design1 comprising derived and/or modified sequence from CCHFV(10200)__NC_005302.1/U88410.1__N (opt11)
gggagaaagcuuaccauggaaaacaaaaucgaggugaacaacaaagacgaaaugaaccgaugguucgaagaguucaagaaaggcaacggacuuguagacacguucaccaacuccuacuccuucugcgaaucaguccccaaccuagaccgauucgucuuccaaauggccagcgcaacagacgacgcacaaaaagacucgauauacgcauccgcccuaguagaagcaaccaaauucugcgcccccaucuacgaaugcgcuuggguaucuagcacaggaaucgucaagaaaggacucgaaugguucgagaaaaacgccggcacaaucaaauccugggacgaaucauacaccgaacuaaaaguagacguacccaaaauagaacaacucaccggcuaccaacaagccgcacuaaaauggcggaaagacaucggcuuccgcgucaacgccaacaccgccgcccucuccaacaaaguccuagccgaauacaaaguccccggcgaaaucgucauguccgucaaagaaaugcucuccgacaugaucagacggcgcaaccucauccuuaaccgcgggggagacgaaaauccccgcggacccgucucucacgaacacgucgacuggugccgcgaguucgucaaaggcaaauacauaauggcguucaacccacccuggggagacauaaacaaaucaggccggucaggcaucgcccucgucgccaccggacuagccaaacucgcagaaacggaaggcaagggcauauucgacgaagcuaagaaaaccgucgaggcacuuaacggauaccuagacaaacacaaagacgaggucgaccgagccagcgcagacagcaugauaaccaaccuacugaaacacaucgcaaaagcgcaagaacuauacaaaaacuccucagcccuccgagcccaaagcgcacaaaucgacacagcauucuccaguuacuacuggcucuacaaagcaggagucacccccgaaacauuccccacagucagccaauuccucuucgaacuaggaaaacaaccccgaggcacaaagaaaaugaagaaagcguuacucagcacccccaugaaauggggcaagaaacuauacgaacucuucgccgacgacuccuuccaacaaaaccgcauauacaugcacccggccguacuuaccgcaggacgcauaucagagaugggcgucugcuucgguaccauccccguggccaacccagacgacgcagcacaaggaucuggccacaccaaaagcauccucaaccuccgcacaaacaccgaaaccaacaacccaugcgcaaaaacaauagucaaacuauucgaaguccaaaagaccggcuucaacauccaagacauggacaucgucgcaucugaacaccuacuccaccaaagccuggucggaaaacaaucccccuuccaaaacgccuacaaugucaaaggcaacgcaaccuccgccaacaucaucuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17001 - RNA, 1666 nt, Artificial Sequence
  mRNA product Design1 comprising derived and/or modified sequence from CCHFV(Turkey-Kelkit06)__GQ337053.1__N (opt11)
gggagaaagcuuaccauggaaaacaaaauagaagucaacuccaaagacgaaaugaacaaaugguucgaagaauuuaaaaaaggcaacggccuaauggacacauucaccaacucuuacuccuucugcgaaaacguccccaaccucgacaaauucgucuuccaaauggccuccgccaccgacgacgcccaaaaagacucaaucuacgccuccgcccuagucgaagccacgaaauucugcgccccaaucuacgaaugcgccuggguaagcuccaccggcauagugaaaaagggcuuagaaugguucgagaaagacuccggaaccauaaaaucaugggacgaaaacuacgcagaacucaaaguagacguacccaaaaucgagcaacucgccaacuaucagcaagcagcccuaaaauggcgcaaagacauagguuuccgcguaaacgccaacaccgccgcccucucaaacaaaguccucgccgaauacaaagucccgggagaaaucgugaugucagucaaagaaaugcuaagcgacaugauccgccgccgcaaucuaauccucaaccgcgguggagacgaaaacccccgagggcccgucagccgagaacacgucgaauggugcagagaauuuguaaaaggcaaauacauuauggcauuuaacccaccauggggcgacaucaacaagucaggacgaaguggaaucgcacucgucgccacaggccucgccaaacucgcagaaaccgaaggaaaaggcgucuucgacgaagcaaaaaaaaccgucgaggcccuuaacggauaccucgacaaacaccgcgacgaagucgacaaagccuccgcggacuccaugauaacaaaccucccaaaacacaucgcgaaagcccaagaacucuacaaaaacuccucagcacucagagcccaaggagcccaaauugacaccccguucuccagcuucuacuggcuuuacaaagcaggcgucacccccgaaacauuccccaccaucagccaguuccuauucgaacucggagaacaaccaagaggaacaaaaaaaaugaaaaaggcccuccucuccacacccaugaaauggggaaaaaaacuguacgaacucuucgccgaugacucauuccaacaaaaccgcaucuacaugcacccugccguccucaccgccggccgcauaagcgaaaugggggucugcuucggcaccauacccgucgccaauccagacgaugcagcccaaggcuccggacauaccaaaagcauccugaaccuccgaaccagcacagaaaccaacaaccccugcgccaagacaaucgucaagcuauuugaaauccaagaaaccggcuucaacauacaggacauggacaucgucgccucggaacaccuccuccaccaauccaucgucggaaaacaaagucccuuccagaacgcauacaacgucaaaggcaacgccacauccgccaacaucaucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17002 - RNA, 5272 nt, Artificial Sequence
  mRNA product Design1 comprising derived and/or modified sequence from CCHFV(10200)__U39455.2__GP (opt11)
gggagaaagcuuaccaugcacaucagccugauguacgccaucuuaugccuacagcugugcggccucggggaaacccacggcucccacaacgagacccgccacaacaagacggacaccaugaccacccacggggacaaccccagcuccgagccgcccgugagcacggcccuguccaucacccuggaccccagcaccgucacccccacgaccccggcguccggccucgaggggagcggcgagguguacaccuccccgcccaucaccacgggcagccugccccuguccgagaccacccccgagcuccccgugaccacggggaccgacacccugagcgccggcgaugucgaccccuccacccagacggccgggggcaccagcgcccccaccgugcggacgucccugccgaacagccccucgacgcccagcacgccccaggacacccaccacccggugcgcaaccuccuguccgucaccagccccgggcccgacgagaccagcaccccguccggcaccggcaaggagagcuccgccaccagcuccccgcacccagugagcaaccggccucccacgccacccgcgaccgcccaggggcccaccgagaacgacucccacaacgccaccgagcaccccgagagccugacgcaguccgccacccccggccucaugaccagccccacccagaucgugcacccccaguccgcgaccccgaucacgguccaggacacccaccccagccccaccaaccgcuccaagcggaaccugaagauggagaucauccugacccucagccaggggcugaagaaguacuacggcaagauccugcgccuccugcagcuaacgcucgaggaggacacggagggccugcucgaauggugcaagcggaaccucgggcuggacugcgacgacaccuucuuccagaagcggaucgaggaguucuucaucaccggcgaggggcacuucaacgaggugcugcaguuccggacgcccggcacccucuccacuaccgagagcacgccggccgggcugcccaccgccgagcccuucaaauccuacuucgccaaggguuuccugagcaucgacuccggcuacuacagcgccaagugcuacagcgggaccuccaacagcggccuccagcugaucaacaucacccgccacuccacucggaucguagacacccccgggccgaagaucacgaaccugaagaccaucaacugcaucaaccucaaggcgagcaucuucaaggagcaccgagagguggagaucaacgugcugcugccccagguggccgucaaccucuccaacugccacguggugaucaagagccacgugugcgacuacucccuggacaucgacggcgccgugcggcugccccacaucuaccacgaggggguguucauccccggcacguacaagaucgucaucgacaagaagaacaagcucaacgaccgcuguacccuuuucaccgacugcgugaucaagggacgggaggugcgcaagggccagagcguccugcggcaguacaagacugagauccgcaucggcaaggccuccaccggguuccggcgccuccugagcgaggaaccguccgacgacugcgugagccggacccagcuguuacgcacagagaccgccgagauccacggcgacaacuacgggggccccggcgacaagaucacgaucugcaacggguccaccaucgucgaccagcgccugggcagugaacuggggugcuacaccaucaaccgggugcgcuccuucaaacugugcgagaacagcgcgaccggcaagaacugcgagaucgacuccgugcccgucaagugccggcagggcuacugccuccgcaucacgcaggaggggcguggccacgugaagcugagccgcgggagcgaggugguccuggacgccugcgacaccuccugcgagauaaugauccccaagggcaccggggacauccuaguggacugcagcgggggccagcagcacuuccugaaggacaaccugaucgaccucgggugcccgaagaucccccugcugggcaagauggccaucuacauuugccggauguccaaccaccccaagaccacgauggccuuccucuucugguucagcuucggguacgugaucacgugcauccugugcaaggcuaucuucuaccugcucaucaucgucggcacccuggggcgccggcugaagcaguaccgugagcucaagccccaaaccugcaccaucugcgagaccaccccgguaaacgcgaucgacgccgagaugcacgaccugaauugcuccuacaacaucugccccuacugcgccucccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguuuaccgugagccuguccccggugcagagcgcgcccaucgggcagggcaagaccaucgaggccuaccgggcccgcgagggguacaccuccaucugccucuucguccugggcagcauccuguucaucguguccugccucaugaagggucugguggacagcgucgguaacuccuucuuccccggccugagcaucugcaagacgugcagcaucuccagcaucaacggguucgagaucgagucccacaagugcuacugcagccucuucugcugcccguacugucggcacugcuccaccgacaaggagauccacaaacugcaccugagcaucugcaagaagcgcaagaccggcuccaacgugaugcucgcugugugcaaacugaugugcuuccgcgcgaccauggagguaagcaaccgggcccuguucauccgcuccaucaucaacacgaccuucgugcucugcauccuuauccuggccgugugcgucgugagcaccuccgccguugagauggagaaccuccccgccgggaccugggagcgggaggaggaccugacgaacuucugccaccaggagugccaagucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcugucauggagcagcguggagcaccggggaaacaaaauccucguguccggccgcagcgaguccaucaugaagcuggaggagcggaccgguaucagcugggaccuuggagucgaggacgccuccgagagcaagcuccugaccguguccgugauggaccuaagccaaauguacucccccgucuucgaguaccucagcggggaccgccagguggaagaauggcccaaggcgaccugcacgggcgacugcccggagcggugcggcugcaccuccagcacgugccugcacaaggaguggccccacucccgcaacuggaggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccaaugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggugugcaagcuccaguccugcacccacggggugcccggcgaccuccagguguaccacaucgggaaccugcugaagggcgacaaggucaacgggcaccugauccacaagauugagccccacuucaacacuagcuggaugagcugggacggcugcgaucuggacuacuauugcaacaugggcgacuggcccuccugcaccuacacaggggugacccagcacaaccacgccagcuucgugaaccuccugaacaucgagaccgacuacaccaagaacuuccacuuccacuccaagcgcgucacggcccacggcgacacgccccagcuugaccucaaggcccggccgaccuacggggcgggcgagaucaccgugcugguggagguagccgacauggagcugcacaccaagaagaucgagaucagcgggcucaaguucgccucccuggccuguaccggcugcuacgccugcagcuccagcaucuccugcaaagugcgcauccacguggacgagcccgacgagcuaaccguccacgucaagagcgacgaccccgaugugguggcggccucgucuuccuuaauggcccggaagcuggaguucggcaccgacucgacguucaaggccuucuccgccaugcccaagaccagccugugcuucuacaucguggagcgcgagcacugcaaguccugcagcgaggaagacaccaagaaaugcgugaacaccaagcucgagcagccgcaauccauccugaucgagcacaaggggacgaucaucggcaagcagaacuccacgugcaccgcgaaagccagcugcuggcuggaaagcgucaagagcuucuucuacgggcugaagaacaugcucuccggcauuuucggcaacguguucauggggaucuuucuguuccuggcccccuucauccuccugauccuguucuucauguucggcuggcggauccucuucugcuucaagugcugccgccgcacccgggggcuguucaaguaccgccaccugaaagacgacgaggagaccggcuaccggcgcauuaucgaaaagcucaacaacaagaaggggaagaacaagcugcuggacggugagcggcucgccgacggccgcauugccgagcuguucagcaccaagacccacaucggguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17003 - RNA, 5272 nt, Artificial Sequence
  mRNA product Design1 comprising derived and/or modified sequence from CCHFV(IbAr10200)__AF467768.2__GP (opt11)
gggagaaagcuuaccaugcacaucagccugauguacgccauccucugccugcagcugugcggccucggggagacccacggcucccacaacgagacccgccauaacaaaaccgacaccaugacgacgcccggggacaacccgagcuccgagccgcccgucagcaccgcccugucgaucacccuggaccccagcacugucacgccgacgacccccgcguccggccucgaggggagcggagagguauacaccucaccgcccauaaccacgggcagccugccccuguccgagaccacccccgagcuccccgugaccacgggaaccgacacccucagcgccggcgacgucgaccccuccacccagacggccgggggcaccagcgccccgaccgugcggaccagccugccuaacucucccuccacgcccagcacgccgcaggacacccaccaccccgugcgcaaccuccuguccgucaccagccccgggcccgacgagacgagcaccccguccggcaccgggaaggaaagcuccgccacaagcagcccccaccccgugagcaaccggcccccgaccccgcccgcgaccgcccagggucccacagagaacgacucccacaacgccaccgagcacccggagagccugacucaguccgccacccccggccucaugaccagccccacccagaucgugcacccgcaguccgcgacccccaucacgguccaggauacucaccccagucccacgaaccgcuccaagcgaaaccugaagauggagaucauccugacccucagccaggggcugaagaaguacuacggcaagauccugcgccuccugcagcugacgcuagaggaggacaccgagggucugcuggaguggugcaagcggaaccucgggcuggacugcgaugacaccuucuuccagaagcgcaucgaggaguucuucaucaccggcgaggggcacuucaacgaggugcugcaguuccgaacgccgggaacccucuccaccacagagagcacgcccgccgggcugcccacggccgagcccuucaaguccuacuucgccaagggcuuccugagcaucgacuccgguuacuacagcgccaagugcuacagcgggacguccaacagcggccuccagcuuaucaacaucacccgccacuccacgcggaucgucgacaccccggggcccaagaucaccaaccugaagaccaucaacugcauaaaccucaaggcgagcaucuucaaggagcaccgcgaggucgagaucaacgugcugcugccccagguggccguaaaccucuccaacugccacguagugauaaagucacacgucugugacuacagucuggacaucgacggcgccgugcggcugccccacaucuaccacgaggggguguucaucccuggcacguacaagaucgucaucgacaagaagaacaaacucaacgaccgcugcaccuuauucacagacugcgugauaaagggccgggagguucgcaaggggcaaagcguccugcggcaguacaagaccgagauccgcaucgggaaggccuccacggggagccggcggcuccuguccgaggagcccagcgacgacugcauuucccggacccagcugcuccgcaccgaaaccgccgagauccacggcgacaacuacgggggccccggcgacaagaucacgauuugcaacggcagcaccaucguggaccagcgccugggcuccgagcuagggugcuacacgaucaaccguguccgcagcuucaagcugugcgagaacucggcuaccggcaagaacugcgagauugacucagugcccgugaagugccggcagggcuacugccuccguaucacucaggaggggcggggccacgugaagcugagccgcggguccgagguggugcucgacgccugcgacaccagcugcgagaucaugaucccuaagggcaccggggacauccucgucgacugcuccggcggccagcagcacuuccucaaggacaaccugaucgaucucggguguccuaagaucccccugcugggcaagauggccaucuacaucugccggaugagcaaccaccccaagaccacgauggcauuccucuucugguucuccuucggguaugugaucaccuguauccucugcaaggcuaucuucuaccuccuuaucaucguuggcacccuggggaagcgccugaagcaguaccgggagcucaagccgcagaccugcaccaucugcgagacgacccccgucaacgcgaucgacgccgagaugcacgaccugaacugcagcuacaacaucugccccuacugcgccucccgucugaccagcgacgggcucgcccggcacgugauucagugccccaagcgcaaagaaaagguggaggagaccgagcuguacuuaaaccucgaacggaucccgugggucgugcgcaagcugcugcagguauccgagagcacgggcgucgcccucaagcgguccagcuggcugaucguacugcucgugcuguucaccgucucccugagccccguacaguccgcgcccaucgggcagggcaagaccauagaagcguaccgcgcccgggagggguacacuucuauuugccucuucgugcugggcuccauccuguucaucgucaguugucucaugaaggggcucguggacucagugggcaacagcuucuucccgggccugagcaucugcaagacgugcucgaucagcuccaucaauggguucgagaucgagagccacaagugcuacugcucccucuucugcugccccuacugccgccacugcagcaccgacaaggagauccacaagcugcaccugucuauaugcaagaagcggaagaagggcagcaacgucauguuagccguuugcaagcugaugugcuuccgcgcgaccauggagguguccaaccgcgcccuguucauccggagcaucaucaacacuacguucguccucugcauacugauacuggccguguguguggucuccaccagcgccguggagauggagaaccuccccgccgggaccugggagcgcgaggaagaccugaccaacuuuugccaccaagagugccaagugacggagaccgagugccugugccccuacgaggcgcucguccugcggaagccgcuguuccucgacuccaccgccaagggcaugaagaaccugcugaacagcacaucccucgagacaagccuguccaucgaggcccccuggggcgccaucaacguucagagcacauacaagccgaccguguccaccgcuaacauugcacugagcuggagcuccgucgagcaccgcgggaacaagauccucgugagcggccgauccgagagcaucaugaagcuggaggagcgcacggggaucuccugggaccugggcguggaggacgccagcgaguccaagcuccugaccgucagcgucauggaccugucucagauguacagcccgguguucgaguaccucaguggggaccggcaggucggagaguggccgaaggcaaccugcaccggcgacugccccgagcgcugcgggugcacgagcucgacuugccugcacaaggaguggccccauagccggaacuggcgcugcaaccccaccuggugcuggggcguggggaccggcugcacgugcugcgggcuggacgucaaagaccucuuuaccgacuacauguucguaaaguggaagguggaguauaucaagaccgaggccaucgugugcgucgagcugaccagucaggaacggcaguguagccugaucgaggccggcacgcgauucaaccucggcccggugaccauaacccuguccgagccccggaacauccagcagaagcugcccccggagaucaucacccuccacccgcgcaucgaagaaggguucuucgaccugaugcacguccagaagguacugagcgccaguacagugugcaagcuccaguccugcacgcauggcgucccaggggaccuccagguguaccacaucggcaaucugcugaaaggggauaaggugaacggccaccugauccacaaaauagagccccacuucaacaccagcuggauguccugggacggcugugaccuggacuacuacugcaacaugggggacuggcccagcugcaccuacaccggcgucacgcagcacaaccacgccuccuucgucaaccuccugaacaucgagaccgacuacaccaagaacuuccacuuccacagcaagcgugugaccgcccacggggacacgccgcaguuagaccucaaagcccgccccacguacggcgcgggggagaucaccguacugguugagguggccgauauggagcugcacacuaagaagauugaaaucuccggccucaaguucgccucgcuggccugcacgggcugcuacgccugcuccucagggaucuccugcaagguccggauccacguagacgagcccgacgagcugacagugcacgucaagagcgacgaccccgacgugguggcggccuccagcucccucauggcccgcaagcuggaguucggcaccgacagcaccuuuaaggccuucuccgccaugccgaagacgagccugugcuucuacaucgucgagcgggagcacugcaaauccugcagcgaggaggacaccaagaagugcgugaacaccaaacucgagcagccccaguccauccugaucgagcacaaggggaccaucauaggcaaacagaacagcacgugcaccgcgaaggccagcugcuggcuggaguccgugaaguccuucuucuacggccugaagaacauguuauccgggaucuucggcaacgucuucauggggaucuucuuguuccuggcacccuucauucuccuuauccuguucuucauguucggcuggcgcauccucuucugcuucaagugcugccgccgcacccgcgggcuguucaaguaccggcaccugaaggacgacgaggagaccggauaucgccggaucaucgagaagcucaacaacaagaagggcaagaacaagcugcuggauggcgagcgccucgccgaccggcgcaucgccgaacuguucagcacgaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17004 - RNA, 5284 nt, Artificial Sequence
  mRNA product Design1 comprising derived and/or modified sequence from CCHFV(Turkey-Kelkit06)__GQ337054.1__GP (opt11)
gggagaaagcuuaccaugcccaccaacauuaugcacaccccgcuggugugcuucauccucuaccugcagcuguuaugccugggcggggcccacggccaacugaacgccacggagcacaacgggaccaacaacacaacggcgcccggcgccagccagucccccaaacccccgaugagcacuacaccaccccacgcccccgaguccagcaccaucaagccgaccacgccaauuuccgaggccgaggggagcggagagaccaccuccccgcccaauaccacgcagggccucaguucccccgagaccaccagcgagcgcccugccaccacguccaucagcacuuccagcaccgacuccaccaaccccacgacgcagaugaccgacaacacccccacuccgaccgucucgaccucccccagcuccagccccagcacccccuccacuccgcaggggauccaccacccagcgcggagccugcuguccguuucuucccccaagaccgugaccacccccacgccgaccagccccggugagauguccagcgagaccuccagccagcacagcgccaugagccgcauccccacuccccacaccgcgacccggguauccaccgagaucaccaaccaccgcaccccgcggcagagcgagucaagcgcccagcagacgacgccuucccccaugaccagcccggcgcaguccauccuccugaugagcgccgcacccaccgccgugcaggacauccaccccagcccaacgaaccgcuccaagcggaaccuggaaaccgagaucauccucacccucagccaggggcugaagaaguacuauggcaagauucucaagcuccugcaccucacccuggagcaagacacggaggggcugcucgaauggugcaagggcaaccugggcuccaacugcgacgacgacuucuuccagaagaggaucgaggaguucuucaugaccggggagugcuacuucaacgaggugcugcaguucaagacccucagcacccuguccccgaccgagcccagccaugcccggcugcccaccgcggagcccuucaaguccuacuucgccaagggguuccugagcaucgacuccggguauuucagcgccaaaugcuacccgcgcuccagcgccucaggccugcagcugaucaacgucacccagcaccccgcccggaucgcugagacccccggccccaaaacgacuagccucaagaccaucaacugcaucaaucugcgcgccuccguguucaaggagcacagagagguggaaaucaacgugcugcucccgcagauagccgugaaccugagcaacugccacguggucaucaacucccacgugugcgacuacagccuggacaccgacgggcccgugcgucucccccgcaucuaccacgagggcacguucauccccgggacauacaagaucgucaucgacaagaagaacaagcugaacgaccgcugcacgcuggugacgaacugcgugaucaagggccgggagguccgcaaagggcagagcguguugcgucaguacaagaccgagaucaagaucggcaaggccuccaccggguuccgcaagcugcugagcgaggaaccgggggacgacugcaucucccggacccaacucuugcgcaccgagacggcugagauccacgacgacaacuacggcgggcccggcgacaaaaucaccaucugcaacggcucaacuauuguggaccagagacugggcuccgaguuaggcugcuacaccaucaaccgggucaagagcuuuaagcugugcaagaacuccgcgacggggaagaccugcgaggucgacagcacccccgugaagugccgucagggcuucugucucaagauuacccaggaggggcggggccacgugaagcugucccgcgggucagaggugguacuggacgccugcgacuccagcugcgaggugaugauccccaagggcacgggcgacauucuaguggacugcagugggggucaacaacacuuucuaaaagacaaccucaucgaccuggggugcccgcacaucccccugcucggccggauggccaucuauaucugccgcaugagcaaccacccccggaccacuauggccuucuuguuuugguucuccuuuggcuacgugauuaccugcaucuucugcaaggcccuguucuauucgcucaucaucaucggaacccuggguaagaagaucaagcaguaccgcgagcugaagccccagacgugcaccaucugcgagaccgcgccggugaacgccaucgacgccgagaugcacgaccucaacugcuccuacaacaucugccccuacugcgcgagcaggcugaccuccgacggacuggcgcgccacgugacgcaaugccccaagcggaaggagaaggucgaggagaccgagcucuaccugaaccuggagcgcaucccguggaucgugcggaagcucuuacaggugagcgagagcaccggcgucgcccugaagcgcuccagcuggcugaucgugcugcugguacuccugaccgucucccugagccccgugcaguccgcccccgucgggcacggcaagacgaucgagaucuaccagacccgggagggcuucgcuagcaucugccucuucaugcugggguccauccuauucaucgucagcugccucgugaagggccugguggacuccguuagcgaguccuucuuccccgggcugucggugugcaagacaugcuccaucggcagcgugaacggguucgagaucgagucccacaagugcuacugcagccucuucuguugcccguacugccgucacugcagugccgaccgggagauccaccagcuucaucugagcaucugcaagaagcgcaagaccggcuccaacgucaugcucgcugugugcaagcggaugugcuuccgcgccacgaucgaggcaagccgucgggcucugcugauacgcagcauaaucaacaccaccuucgugaucugcauccucacccugacgaucugcgucguguccaccagcgccguggagauggagaaccugcccgccggcaccugggagcgggaagaggaccucaccaacuucugccaccaggagugccaggucacggagaccgagugccugugccccuaugaagcccuggugcuccgcaagccccuguuucuggacuccaucgugaaggggaugaaaaaccuccugaacagcaccucccuggagaccagccuguccaucgaggccccguggggcgccaucaacgugcagagcacauucaagcccaccguguccacugccaacaucgcgcugagcuggucuagcgugguccaccgggggaacaagauccugguuaccggccgcuccgagagcaucaugaagcucgaggagcggacggggguauccugggaccugggcguagaggacgccagcgagucgaagcugcucaccgugagcaucauggaccugucccagauguacagccccguguucgaguaucugagcggcgaccgccagguagaggaguggcccaaggcuaccugcaccggugacugcccggagcggugcggcugcacgucgagcaccugucuccacaaggaauggucccacagccgcaacuggcggugcaaccccaccuggugcuggggcguggggaccggaugcacgugcugcggcguggacgucaaggaccuauuuaccgaccacauguucgugaaguggaagguggaauacaucaaaaccgaagccaucguuugcguggcgcugaccucccaggagcgccagugcagccucaucgaggccggaacccgguuuaaccuagggccggugacgauuacccucuccgagccccgcaacauccagcagaaacucccgcccgagauuaucacccugcaccccaaaaucgaggagggcuuuuucgaucugaugcacguccagaaggugcucagcgccuccaccgugugcaagcugcagagcugcacgcacgggauccccggcgaccugcaggucuaccauaucggcaaccuccugaagggggaccgcgugaacggccaccugauccacaagaucgagucccacuucaacaccagcuggauguccugggacgggugugaccucgacuacuacugcaacaugggcgacuggccgagcugcaccuacaccggggucacucagcacaaccacgccgccuucgugaaccugcugaacaucgagaccgacuacaccaagaccuuccacuuucacuccaagcgcguaacggcgcauggcgacaccccucagcucgaccugaaggcccggcccaccuacggcgccgggggcaucaccguccuggucgagguggcugacauggagcuccacacuaagaaggucgaaaucagcggacugaaguucgccucccucgcgugcaccggcugcuacgccugcagcagugggaucagcugcaagguacgcauccacguggacgagccggacgagcucacuguccacguaaagagcagcgacccggacgugguugccgcgucgaccucacugauggcccggaaacuggaguucggcacggacucaacguuuaaggcguucuccgccaugcccaagaccagccucugcuucuacaucguggagcgcgaguacugcaaguccugcagcgaggacgacacccagaaguguguggacacgcggcuggagcaaccccaguccauacugaucgagcacaaaggcacaaucaucgggaagcagaacgauaccugcaccgccaaggccagcugcuggcucgaguccgucaagaguuucuucuacggccugaagaacaugcugggguccguguucggcaaccuauucaucgggauccuccuguuccucgcgcccuucguguuacucguccuguuuuucauguucggcuggaagauccucuucugcuucaaguguugccgccgcacgcggggccuguucaaguaccgccaccugaaggacgacgaggagaccggguaccggagaaucaucgagcgacucaauagcaagaagggcaagaaccgccugcuggacggggaccgacucgccgaccgcaagauagccgagcuauucuccaccaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17005 - RNA, 3796 nt, Artificial Sequence
  mRNA product Design1 comprising derived and/or modified sequence from CCHVF(10200)__U39455.2__SP-GP_Gn-NSm-Gc (opt11)
gggagaaagcuuaccaugcacaucagccugauguacgccauccucugccugcagcugugcggccucggggagacccacggcucccacaacgagaccagcgaggagcccuccgacgacugcgugagccgcacgcagcugcugcggaccgagaccgccgagauccacggggacaacuacggcgggccgggcgacaagaucaccaucugcaacggcuccacgaucgucgaccagcgccucgggagcgagcugggcugcuacaccaucaaccgggugcgcuccuucaagcugugcgagaacagcgcgaccgggaagaacugcgagaucgacuccgugcccgucaagugccggcagggcuacugccuccgcaucacccaggaggggcggggccacgugaagcugagccgcggcuccgaggugguccuggacgccugcgacacgagcugcgagaucaugauccccaaggggaccggcgacauccucguggacugcuccgggggccagcagcacuuccugaaggacaaccugaucgaccucggcugccccaagaucccgcugcuggggaagauggccaucuacaucugccggaugagcaaccaccccaagaccaccauggccuuccucuucugguucuccuucggcuacgugaucacgugcauccugugcaaggccaucuucuaccugcucaucaucgucgggacccugggccgccggcugaagcaguaccgcgagcucaagccccagaccugcaccaucugcgagacgacccccgugaacgcgaucgacgccgagaugcacgaccugaacugcagcuacaacaucugcccguacugcgccucccggcugaccagcgacgggcucgcccgccacgugauccagugccccaagcggaaggagaaggucgaggagaccgagcuguaccugaaccucgagcgcauccccuggguggugcggaagcugcugcaggucuccgagagcacgggcguggcgcucaagcgcagcuccuggcugaucgugcugcucguccuguucaccgugagccugucccccgugcagagcgccccgaucggccaggggaagaccaucgaggccuaccgggcccgcgagggcuacaccuccaucugccucuucguccuggggagcauccuguucaucguguccugccucaugaagggccugguggacagcgucgggaacuccuucuuccccggccugagcaucugcaagacgugcuccaucagcuccaucaacggcuucgagaucgagagccacaagugcuacugcucccucuucugcugccccuacugccggcacugcagcaccgacaaggagauccacaagcugcaccuguccaucugcaagaagcgcaagaccgggagcaacgugaugcucgccgucugcaagcugaugugcuuccgcgcgaccauggagguguccaaccgggcccuguucauccgcagcaucaucaacacgaccuucgugcugugcauccucauccuggccgucugcguggugagcaccuccgccgucgagauggagaaccugcccgccggcaccugggagcgggaggaggaccucacgaacuucugccaccaggagugccaggugaccgagaccgagugccugugcccguacgaggcgcuggugcuccgcaagccccuguuccuggacagcaccgccaaggggaugaagaaccuccugaacuccacgagccuggagaccucccucagcaucgaggcccccuggggcgccaucaacguccaguccaccuacaagcccaccgugagcaccgccaacaucgcgcuguccuggagcuccguggagcaccgggggaacaagauccuggucagcggccgcuccgagagcaucaugaagcucgaggagcggacgggcaucuccugggaccuggggguggaggacgccagcgaguccaagcugcucaccgugagcgucauggaccugagccagauguacuccccgguguucgaguaccugagcggcgaccgccagguggaggaguggcccaaggccaccuguaccggggacugccccgagcggugcggcugcacguccagcacaugccuccacaaggaguggccccacucccgcaacuggcggugcaacccgaccuggugcuggggcgucgggaccggcugcacgugcugcgggcuggacgugaaggaccuguucaccgacuacauguucgugaaguggaaggucgaguacaucaagaccgaggccaucgugugcguggagcucaccagccaggagcgccagugcucccugaucgaggccggcacgcgguucaaccuggggcccgucaccaucacccucagcgagccccgcaacauccagcagaagcugcccccggagaucaucacccugcacccccggaucgaggagggcuucuucgaccucaugcacgugcagaaggugcuguccgcgagcacggucugcaagcugcaguccugcacccacggcgugcccggggaccuccagguguaccacaucggcaaccugcugaagggggacaaggucaacggccaccucauccacaagaucgagccgcacuucaacaccagcuggauguccugggacgggugcgaccuggacuacuacugcaacaugggcgacuggcccagcugcaccuacacgggcgugacccagcacaaccacgccuccuucgugaaccugcucaacaucgagaccgacuacaccaagaacuuccacuuccacagcaagcgcgucacggcccacggggacaccccccagcuggaccugaaggcccggcccaccuacggcgcgggggagaucaccgugcucguggaggucgccgacauggagcugcacacgaagaagaucgagaucuccggccugaaguucgccagccucgccugcaccgggugcuacgccugcuccagcagcaucuccugcaaggugcgcauccacguggacgagccggacgagcugaccguccacgugaagagugacgaccccgacguggucgcggccuccagcucccugauggcccggaagcucgaguucggcaccgacagcacguucaaggccuucuccgccaugcccaagaccagccugugcuucuacaucguggagcgcgagcacugcaaguccugcagcgaggaggacaccaagaagugcgugaacaccaagcuggagcagccccaguccauccucaucgagcacaagggcacgaucaucgggaagcagaacagcacaugcaccgcgaaggccuccugcuggcuggagagcgucaaguccuucuucuacggccugaagaacaugcucagcgggaucuucggcaacguguucauggggaucuuccuguuccuggccccguucauccuccugauccuguucuucauguucggcuggcgcauccucuucugcuucaagugcugccggcgcacccggggccuguucaaguaccgccaccugaaggacgacgaggagaccggguaccggcgcaucaucgagaagcucaacaacaagaagggcaagaacaagcugcuggacggggagcggcucgccgacggccgcaucgccgagcuguucuccacgaagacccacaucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17006 - RNA, 3769 nt, Artificial Sequence
  mRNA product Design1 comprising derived and/or modified sequence from CCHVF(10200)__U39455.2__IgE-leader_Gn-NSm-Gc (opt11)
gggagaaagcuuaccauggacuggaccuggauccuguuccucguggcagccgcgacucgcguacacucauccgaggagcccagcgacgacuguguguccagaacgcagcuguugcgcacggagacggccgagauccacggcgacaacuacgggggcccgggggacaagaucaccauaugcaacggcagcaccaucguagaccagcggcucggguccgagcuaggcuguuacaccaucaaccguguccggagcuucaagcugugcgaaaauucagccaccggcaaaaacugcgagaucgacagcguucccgugaagugucgccagggguacugccuccggaucacccaggagggcagagggcacgucaaguuaucucggggcagcgagguagugcuggacgcgugcgacacguccugcgagaucaugauacccaaggggaccggcgacauccucgucgacugcagcggcgggcaacagcacuuccugaaggacaaccugaucgaucucggcugccccaagaucccgcuacuggggaaaauggccaucuacaucugccgaauguccaaccacccaaagaccaccauggcguuccucuucugguucagcuucggguacgugaucacaugcauucugugcaaggccaucuucuaccugcucaucaucgugggcacccuggggcggcgccugaaacaguacagagagcucaagccccagaccugcaccaucugcgagaccaccccggucaacgcgauugaugccgagaugcacgaccuaaacuguuccuacaacaucugcccguacugcgcgagccgccugacguccgacggccucgcccggcacgugauccagugccccaagcgcaaggagaagguggaggagaccgaguuauaccucaaccuagagcggaucccuugggucguucggaaguugcuccaggugagcgaguccacggggguugcccucaagaggagcagcuggcugaucgugcugcucguacuguucaccgucagucugagccccgugcaguccgcuccgaucgggcaggggaagaccaucgaggcguaucgggccagggagggcuacaccagcaucugccucuucguccugggcuccauccuguucaucgucagcugccugaugaaggggcugguggacagugucggcaacagcuucuuccccgggcuaagcaucugcaagacgugcagcaucuccuccaucaacggcuucgagaucgaaucccacaagugcuacugcucccucuucugcugccccuacugccgccauugcuccaccgacaaggagauccacaagcugcaccugucaaucugcaagaagaggaaaaccggguccaacgugaugcuagccgugugcaagcugauguguuuccgggcuaccauggaggucagcaaccgcgcccuguucauuagguccauuaucaauaccacuuucgugcucugcauccugauccuggcggugugcgucgugagcaccagcgcaguggaaauggagaaccuaccugccggcaccugggagcgggaggaggaucucacgaacuucugccaccaggagugucaggucacagagaccgagugccuuugcccguacgaggcccugguacucaggaagccccuguuucuggacuccaccgccaagggcaugaaaaaccuccugaacuccacaucccuggagaccagccucuccauagaggcccccuggggcgcgaucaacgugcagucaaccuacaaacccaccgucuccaccgcuaacauugcccugagcugguccucgguggagcacagggggaacaagauucugguguccgggcggucagagagcaucaugaagcucgaggagcgcacgggcaucagcugggaucugggggucgaagaugccuccgagagcaaguugcucacagugaguguaauggaccugagccagauguacagcccgguuuucgaguaccuguccggcgaccgccagguggaagaguggcccaaggcaacuugcacaggcgacugccccgagcggugcgggugcacgagcucgaccugccuucauaaagaguggccacacagccggaacuggcgcugcaacccgaccuggugcuggggcguggggaccggguguacgugcugcgggcuggacgucaaggaccuguucaccgacuacauguucgugaaguggaagguggaguacaucaagaccgaggcgaucgucugcguggagcucaccucgcaggagcgucagugcagccugaucgaggccgggacgcgcuucaaccugggccccgugaccaucacccucuccgaaccgcggaacauccaacaaaagcugccaccggagaucaucacccugcacccccgcauugaggagggcuucuucgaccucaugcacguccaaaaggugcugagcgcaucuacugugugcaaacugcagagcuguacccacggaguacccggggaccuccaaguauaccacaucgguaaucugcugaagggagacaaggugaacgggcaucucauccacaagaucgagccgcacuucaauaccuccuggaugagcugggacggcugcgaccuggauuacuauugcaacaugggggacuggccguccugcacuuauacgggcguuacucagcacaaucacgccagcuucgugaaccuacucaacauagagaccgacuacaccaaaaauuuccacuuucacuccaagcgggugacagcacacggggacacuccccaacuggaccugaaggcccgccccaccuauggcgccggagagauaacgguccucguggagguggccgacauggagcugcacacgaagaagaucgagaucagcggguugaaguucgccucccucgccugcaccggaugcuaugcgugcagcuccagcaucucaugcaagguccggauccacguggacgagccggacgagcugaccgugcacguaaaaagcgacgaccccgaugucguggccgccagcuccagccugauggcgcgcaaacucgaguucgggaccgacuccaccuucaaggcguucagcgcaaugcccaagacgagccugugcuucuacaucgucgagagagagcacugcaagagcugcucagaggaggacaccaaaaagugcgugaacaccaagcuggagcagccccagagcauccuaaucgaacauaaggggacaaucaucgggaagcagaacuccacuugcaccgcgaaagccucuugcuggcuagagucuguaaagagcuucuucuacgggcuaaagaacaugcucuccggcaucuucgggaauguuuucaugggcaucuucuuauuccucgcgcccuucauccuccugauccuguucuuuauguucggauggcggauucuguucuguuucaagugcugccgccggacccgcggccuuuucaaguacagacauuugaaagacgacgaggagaccggguacagaagaaucaucgagaagcucaacaacaagaaaggcaagaacaagcugcuggacggcgaacggcucgcugacgggcggaucgccgaacucuucagcacgaagacccauauuggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17007 - RNA, 3190 nt, Artificial Sequence
  mRNA product Design1 comprising derived and/or modified sequence from CCHVF(10200)__U39455.2__IgE-leader_Gn-4aa-Gc (opt11)
gggagaaagcuuaccauggacuggaccuggauccucuuucugguugccgcagccacccgcguucacuccagcgaagaacccucggacgacugcguuaguagaacucaacuccuacggacagaaaccgcagagauccacggcgauaacuacggcggccccggcgacaagauuacuaucugcaacggcagcaccaucgucgaccaacgacucggcucagaacuaggcugcuacaccauuaaccgcguccgcagcuucaaacuaugcgagaacagcgcgaccgggaagaacugcgaaaucgacucaguaccugucaaaugcagacaaggauacugccugcgaaucacccaagaaggucgcggacacgucaagcuaucccgcggaucagaaguuguucuggacgcgugcgacaccaguugcgaaaucaugauaccaaaaggcaccggugacauucucguagacugcagcggcggccaacaacacuuuuuaaaagacaaccucaucgaccucggaugcccaaaaauaccucuccucgguaaaauggcuaucuacauaugcaggaugucuaaccaucccaaaacaacgauggcuuuccuuuucugguucuccuuuggguacgucauaaccugcauacucugcaaagcaaucuucuaccuccucaucaucguagggacacuaggacgccgauuaaaacaguaccgcgagcuaaaaccacaaacaugcacaauuugcgagacaacaccagucaacgcaaucgaugcugaaaugcacgaccucaacuguucauauaacaucugccccuacugcgccucgcgucuaaccucagacggccucgccagacacgucauccaaugccccaagcgcaaggaaaaggucgaagaaaccgaacuauacuugaaccuagaacgcaucccguggguugucagaaaacugcuucaggucucagaaucuaccggaguagcccucaagcgcucauccuggcucauuguacugcucguacucuuuaccgugagcuuaagcccaguccaauccgcccccaucggccgaaaaccacuauuccucgauuccacagccaaagguaugaaaaaccuccucaauucgaccucccucgaaaccucccucucgaucgaagcccccuggggcgccauaaacguccaauccacuuacaaaccuacugugucuacagcaaauaucgcccuauccuggucuuccguagagcaccgcgggaacaaaauacucguaucuggccgcuccgagagcaucaugaagcucgaagaacgcaccggaaucuccugggaccuuggcguagaggaugcgucagaaucaaagcuccuuaccgucagcgucauggaccuaucgcaaauguacuccccagucuucgaauaccugagcggcgaccgccagguggaagaguggcccaaagcaaccugcaccggggacugccccgaacggugcgguugcacuucgucaacaugccuucacaaagaauggccccacagccggaacuggcgcuguaaccccacauggugcuggggcgucgguaccggauguacaugcugcggacuugauguaaaggaccuuuucaccgacuauauguucguuaaguggaagguugaauacaucaaaacagaagcaauagucugcgucgagcucacaucccaagagcgucaaugcucccuaauagaagcuggaacccgcuuuaacuuagguccggucacaauaacacuaucagaaccucgcaauauccaacaaaagcucccucccgaaaucaucacccuucacccccgcaucgaagaaggauucuucgaccucaugcacguccaaaaagugcucagcgccagcacagucuguaaacuccaauccuguacccacggcguacccggagaccuacaaguuuaucacauagggaaucuccuaaaaggggacaaagucaauggccaccucauacacaaaaucgagccacacuucaacaccagcuggauguccugggacgggugcgaucuagacuacuacugcaacaugggggacuggcccucuugcaccuacacgggagucacacagcacaaucacgccucauucguaaaccuucuaaacaucgaaacggacuacacuaaaaauuuccacuuccacucgaaaagggucacagcacacggcgacacaccccagcucgaccucaaagcccgccccaccuacggcgcaggagaaaucacaguacucguugaaguagccgacauggagcuacauaccaagaaaaucgaaaucucaggacucaaauuugccucacuagccugcacgggcugcuacgcaugcucaucuuccaucuccugcaaaguacgcauccacgucgacgaaccagacgagcucaccguccaugucaaaagcgaugacccagacguggucgccgcuuccagcucucuuauggcucgaaaacuagaguucggcacagacuccaccuucaaggcuuucucggccaugcccaaaaccucgcucugcuucuacaucguugagcgggagcacuguaaauccugcuccgaagaagauaccaaaaagugcgucaacaccaaacucgagcaaccgcaguccauucucaucgaacacaaaggcacaaucaucggaaaacaaaacagcacaugcaccgccaaggcauccuguuggcuugaaagcgugaaguccuucuucuacggacucaaaaacaugcuauccggcaucuucggcaacgucuucaugggaaucuuccuguuucuggcccccuuuauacuccuaauacucuucuucauguucggauggcgcauccucuuuugcuucaaauguugcagacgaacacgcggccucuucaaauaccgccaccucaaagacgacgaagaaacgggcuaucgcagaauaaucgaaaaauugaacaacaagaaaggcaaaaacaaacuccuggacggagaacgauuagccgacggcaggauagccgaacuauuuucaaccaaaacgcacauagguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17008 - RNA, 1246 nt, Artificial Sequence
  mRNA product Design1 comprising derived and/or modified sequence from CCHVF(10200)__U39455.2__IgE-leader_Gn (opt11)
gggagaaagcuuaccauggacuggaccuggauccucuuccuaguugccgccgcuacccgcguccacuccucagaggaacccuccgacgacugcgucucccgcacucaacucuuacgcaccgaaacagccgagauccacggcgacaacuacgggggacccggcgacaaaaucaccauaugcaacggcuccaccaucgucgaccaacgccucggcucagaacucggcugcuacacgaucaaccgaguccgcucuuucaaacucugugaaaacucagcaaccggcaaaaacugugaaaucgacuccguacccgugaaaugcagacaaggauauugccuccgaaucacccaagaaggacgcggccacgucaaacucagccgaggcucagaagucguccucgacgccugcgacaccucaugcgaaaucaugauccccaaaggaaccggcgacauccucgucgacugcuccggcggccaacaacacuuccuuaaagacaaccucauagaccucggaugccccaaaauaccucuacuagggaaaauggccaucuacauaugccgcauguccaaccaccccaaaacaacuauggccuuccuuuucugguucucguucggcuacgucaucacaugcauccucugcaaagccaucuuuuaccuacuuaucaucguaggcacccuaggccgccgucuaaaacaauaccgcgaacucaaaccccaaaccugcaccaucugcgaaaccacccccguaaacgccaucgacgcagaaaugcacgaccuaaacugcuccuacaacaucugcccauacugcgccucccgccuaaccuccgacggacucgcccgccacgucauccaaugccccaaacgcaaagaaaaaguagaagaaacagaacuauaccuaaaccuagaacgcauaccgugggucguccguaaacuccuccaagucucagaauccaccggcgucgcacucaaacgaucaagcuggcuaaucguccuccucguccucuucaccgucucacuaucccccguccaauccgcccccaucggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17009 - RNA, 2206 nt, Artificial Sequence
  mRNA product Design1 comprising derived and/or modified sequence from CCHVF(10200)__U39455.2__IgE-leader_Gc (opt11)
gggagaaagcuuaccauggacuggaccuggauccucuuccucgucgccgccgcaacacgcguucacagcuuccucgacagcaccgccaagggcaugaaaaaccuacucaacucgaccucccuagagacaucccucuccaucgaagcccccuggggagccaucaacguccaauccaccuacaaaccaaccguguccacggccaacauagcgcuaagcugguccagcgucgagcaccgaggaaacaagauccuagucucgggccgaagcgaaucaauaaugaagcucgaggaacgcacgggaaucucaugggaucucggcgucgaagacgcaagcgaaucaaaacuccuuacagugagcgucauggaccuuucacaaauguacucgcccguauucgaauaccuuagcggagaccgccaaguugaagaguggcccaaagcgaccugcaccggcgacugccccgaacguuguggcuguacaucgagcacaugccuacacaaagaauggccacauuccagaaacuggcgcugcaacccgaccuggugcuggggcgugggcacaggcugcacaugcugcggccuugacgucaaagaccuauucaccgacuacauguucgucaaauggaaaguagaauacauaaaaaccgaagcaauagucugcgucgaacuaaccucccaagaacgacaaugcucacucauagaagcuggaacccgcuucaaccucggacccguaacgaucacucucuccgaaccccgaaacauccagcaaaaacucccucccgaaaucauaacccuacacccacguaucgaagaaggcuucuucgaccuaaugcacgugcaaaaaguacucagcgcguccaccguuugcaaacuccaaucuugcacucacggcguacccggcgaccugcaagucuaccacaucggcaaccuccucaagggcgacaaaguaaauggucaccugauccacaaaaucgagccccacuucaacaccuccuggaugagcugggacggaugcgaccucgacuacuacugcaacaugggagacuggcccucaugcacguacaccggcgucacccaacacaaccacgccucauucguaaaccugcugaacaucgaaaccgacuauaccaagaacuuccacuuccacagcaaaagagucaccgcccacggcgacacaccccaauuagaccucaaagcccgccccaccuacggcgccggcgaaauaaccguccucgucgaagucgcagacauggaacuacacacaaagaaaauagaaauuuccggccugaaauucgcaucacucgcaugcacaggcugcuacgcgugcucaagcucaauauccuguaaaguccgaauccacguagaugaaccagacgagcucaccguacacgucaagucagacgacccagacguaguagcggccucauccucccucauggcacgaaaacuagaguucggcacagacucaacauucaaagcauucagcgcaaugccaaaaaccucccuuugcuucuacaucgucgaacgcgaacacugcaaaagcugcagcgaagaagacacaaagaaaugcguuaacaccaaacuugaacaaccccaaagcauccugauagaacacaaaggcacuaucaucggaaagcagaacucaaccugcacugccaaggccagcugcuggcucgaaagcgugaaaucauucuuuuacggacugaaaaacaugcuaagcggcauuuucgguaacguauucaugggcaucuuccucuuccuggccccguucauccucuuaauacuauuuuucauguucggcuggagaauccuauucuguuucaaaugcugccgccgcacgcgcggccuuuuuaaauaucgccaccuuaaggacgaugaagaaaccggcuaccgccgaauaauagaaaaacuaaacaacaaaaagggcaaaaacaaacuccucgacggcgaacgccuugcagacggccgcauagccgaacucuucagcacaaaaacccacauaggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17010 - RNA, 1831 nt, Artificial Sequence
  mRNA product Design2 comprising derived and/or modified sequence from CCHFV(10200)__NC_005302.1/U88410.1__N (wt)
ggggcgcugccuacggagguggcagccaucuccuucucggcaucaagcuuaccauggaaaacaagaucgaggugaauaacaaagaugagaugaacaggugguuugaagaguucaaaaaaggaaauggacuuguggacaccuucacaaacuccuauuccuuuugcgagaguguucccaauuuggacagguuuguguuucagauggccagugccaccgaugaugcacagaaggacuccaucuacgcaucugcucugguggaggcaacaaaguuuugugcaccuauauaugagugcgcauggguuagcuccacuggcauuguaaaaaagggacuugaaugguucgagaaaaaugcaggaaccauuaaguccugggaugaaaguuauacugagcuaaaggucgacgucccgaaaauagagcagcuuaccgguuaccaacaagcugccuugaaguggagaaaagacauagguuuccgugucaaugccaacacagcagcucugagcaacaaaguccucgcagaauacaaagucccuggugagauugugaugucugucaaagagaugcugucagacaugauuaggagaaggaaccugauucuaaacagggguggugaugagaacccacguggcccagugagccaugagcauguagacuggugcagggaguuugucaaaggcaaauacaucauggccuucaacccaccauggggggacaucaacaagucaggccguucaggaauagcacuuguugcaacaggccuugcuaagcuugcagagacugaaggaaagggaauauuugaugaagccaaaaagacuguggaggcccucaacggguaucuggacaagcauaaggacgaaguugauagagcaagcgccgacagcaugauaacaaaccuucuuaagcauauugccaaggcacaggagcucuauaaaaauucaucugcacuucgugcacaaagcgcacagauugacacugcuuucagcucauacuauuggcuuuacaaggcuggcgugacuccugaaaccuucccgacggugucacaguuccucuuugagcuagggaaacagccaagagguaccaagaaaaugaagaaggcucuucugagcaccccaaugaagugggggaagaagcuuuaugagcucuuugccgaugauucuuuccagcagaacaggauuuacaugcauccugccgugcuuacagcugguagaaucagugaaaugggagucugcuuugggacaaucccuguggccaauccugaugaugcugcccaaggaucuggacacacuaagucuauucucaaccuccguaccaacacugagaccaauaauccgugugccaaaaccaucgucaagcuauuugaaguucaaaaaacaggguucaacauucaggacauggacauaguggccucugagcacuugcuacaccaaucccuuguuggcaagcaauccccauuccagaacgccuacaacgucaagggcaaugccaccagugcuaacaucauuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17011 - RNA, 1831 nt, Artificial Sequence
  mRNA product Design2 comprising derived and/or modified sequence from CCHFV(10200)__NC_005302.1/U88410.1__N (wt)
ggggcgcugccuacggagguggcagccaucuccuucucggcaucaagcuuaccauggaaaacaagaucgaggugaauaacaaagaugagaugaacaggugguuugaagaguucaaaaaaggaaauggacuuguggacaccuucacaaacuccuauuccuuuugcgagaguguucccaauuuggacagguuuguguuucagauggccagugccaccgaugaugcacagaaggacuccaucuacgcaucugcucugguggaggcaacaaaguuuugugcaccuauauaugagugcgcauggguuagcuccacuggcauuguaaaaaagggacuugaaugguucgagaaaaaugcaggaaccauuaaguccugggaugaaaguuauacugagcuaaaggucgacgucccgaaaauagagcagcuuaccgguuaccaacaagcugccuugaaguggagaaaagacauagguuuccgugucaaugccaacacagcagcucugagcaacaaaguccucgcagaauacaaagucccuggugagauugugaugucugucaaagagaugcugucagacaugauuaggagaaggaaccugauucuaaacagggguggugaugagaacccacguggcccagugagccaugagcauguagacuggugcagggaguuugucaaaggcaaauacaucauggccuucaacccaccauggggggacaucaacaagucaggccguucaggaauagcacuuguugcaacaggccuugcuaagcuggcagagacugaaggaaagggaauauuugaugaagccaaaaagacuguggaggcccucaacggguaucuggacaagcauaaggacgaaguugauagagcaagcgccgacagcaugauaacaaaccuucuuaagcauauugccaaggcacaggagcucuauaaaaauucaucugcacuucgugcacaaagcgcacagauugacacugcuuucagcucauacuauuggcuuuacaaggcuggcgugacuccugaaaccuucccgacggugucacaguuccucuuugagcuagggaaacagccaagagguaccaagaaaaugaagaaggcucugcugagcaccccaaugaagugggggaagaagcuguaugagcucuuugccgaugauucuuuccagcagaacaggauuuacaugcauccugccgugcuuacagcugguagaaucagugaaaugggagucugcuuugggacaaucccuguggccaauccugaugaugcugcccaaggaucuggacacacuaagucuauucucaaccuccguaccaacacugagaccaauaauccgugugccaaaaccaucgucaagcuauuugaaguucaaaaaacaggguucaacauucaggacauggacauaguggccucugagcacuugcuacaccaaucccuuguuggcaagcaauccccauuccagaacgccuacaacgucaagggcaaugccaccagugcuaacaucauuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17012 - RNA, 1831 nt, Artificial Sequence
  mRNA product Design2 comprising derived and/or modified sequence from CCHFV(Turkey-Kelkit06)__GQ337053.1__N (wt)
ggggcgcugccuacggagguggcagccaucuccuucucggcaucaagcuuaccauggaaaacaagaucgaggugaacagcaaggaugagaugaacaaaugguuugaggaguuuaaaaagggaaauggacuuauggacacuuucacaaacuccuacuccuuuugugagaauguaccaaaucuggauaaguuuguguuccagauggccagcgccacagaugaugcacagaaggacuccaucuaugcaucggcucuaguggaagcaaccaaguucugugcacccauauaugaaugugcuugggucagcucuacuggcauugugaagaaggggcuugagugguucgagaaggauucaggaacuaucaaaucaugggaugagaacuaugcugagcugaagguugauguucccaaaauagaacaacuugccaauuaccaacaggcugcucuuaaguggaggaaggacauagguuuccgugucaacgcaaacacggcagccuuaagcaacaaaguccuugcagaauacaaagucccuggugaaauugugaugucuguuaaagaaaugcugucagacaugauuagaaggaggaaucuaauucucaacaggggcggugaugaaaauccacgcggcccagugagccgugaacauguggaguggugcagggaauuugucaaaggcaaguacaucauggcuuucaauccaccuuggggggacaucaacaaaucaggucguucgggaauagcacuuguugcaacaggccuugccaagcuugcagagaccgaggggaaaggaguuuuugacgaagcuaagaagaccguggaggcucucaauggguauuuggacaagcacagggacgaagucgacaaagcaagugcugacagcaugauaacaaaccucccuaagcacauugccaaagcacaagagcuuuauaaaaauucaucugcucuucgugcacaaggugcacagauugacaccccuuucagcucguuuuacuggcucuacaaggccggugugacuccagagaccuucccaaccaucucacaguuccuuuuugaacugggggagcagccaagggggaccaaaaaaaugaaaaaggcacuccugagcacuccaaugaagugggggaagaaacuuuaugagcucuuugcugaugacucuuuccagcagaacagaaucuacaugcacccugcuguguugacagccgguagaaucagugaaaugggugucugcuuuggaacaaucccuguugccaauccugaugaugcugcucagggaucuggacauaccaaguccauucucaaccuucggacaagcacagagaccaacaauccaugcgccaagacaauugucaaauuauuugaaauccaagaaacaggauuuaacauacaggacauggacauuguggccucugagcacuugcugcaccaauccauuguuggcaagcaaucuccauuccaaaaugccuacaacgucaagggcaaugccaccagugccaacaucaucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17013 - RNA, 1831 nt, Artificial Sequence
  mRNA product Design2 comprising derived and/or modified sequence from CCHFV(Turkey-Kelkit06)__GQ337053.1__N (wt)
ggggcgcugccuacggagguggcagccaucuccuucucggcaucaagcuuaccauggaaaacaagaucgaggugaacagcaaggaugagaugaacaaaugguuugaggaguuuaaaaagggaaauggacuuauggacacuuucacaaacuccuacuccuuuugugagaauguaccaaaucuggauaaguuuguguuccagauggccagcgccacagaugaugcacagaaggacuccaucuaugcaucggcucuaguggaagcaaccaaguucugugcacccauauaugaaugugcuugggucagcucuacuggcauugugaagaaggggcuugagugguucgagaaggauucaggaacuaucaaaucaugggaugagaacuaugcugagcugaagguugauguucccaaaauagaacaacuugccaauuaccaacaggcugcucuuaaguggaggaaggacauagguuuccgugucaacgcaaacacggcagccuuaagcaacaaaguccuugcagaauacaaagucccuggugaaauugugaugucuguuaaagaaaugcugucagacaugauuagaaggaggaaucuaauucucaacaggggcggugaugaaaauccacgcggcccagugagccgugaacauguggaguggugcagggaauuugucaaaggcaaguacaucauggcuuucaauccaccuuggggggacaucaacaaaucaggucguucgggaauagcacuuguugcaacaggccuugccaagcuggcagagaccgaggggaaaggaguuuuugacgaagcuaagaagaccguggaggcucucaauggguauuuggacaagcacagggacgaagucgacaaagcaagugcugacagcaugauaacaaaccucccuaagcacauugccaaagcacaagagcuuuauaaaaauucaucugcucugcgugcacaaggugcacagauugacaccccuuucagcucguuuuacuggcucuacaaggccggugugacuccagagaccuucccaaccaucucacaguuccuuuuugaacugggggagcagccaagggggaccaaaaaaaugaaaaaggcacuccugagcacuccaaugaagugggggaagaaacuuuaugagcucuuugcugaugacucuuuccagcagaacagaaucuacaugcacccugcuguguugacagccgguagaaucagugaaaugggugucugcuuuggaacaaucccuguugccaauccugaugaugcugcucagggaucuggacauaccaaguccauucucaaccuucggacaagcacagagaccaacaauccaugcgccaagacaauugucaaauuauuugaaauccaagaaacaggauuuaacauacaggacauggacauuguggccucugagcacuugcugcaccaauccauuguuggcaagcaaucuccauuccaaaaugccuacaacgucaagggcaaugccaccagugccaacaucaucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17014 - RNA, 5437 nt, Artificial Sequence
  mRNA product Design2 comprising derived and/or modified sequence from CCHFV(10200)__U39455.2__GP (wt)
ggggcgcugccuacggagguggcagccaucuccuucucggcaucaagcuuaccaugcauauaucauuaauguaugcaauccuuugccuacagcuguguggucugggagagacucauggaucacacaaugaaacuagacacaauaaaacagacaccaugacaacacacggugauaacccgagcucugaaccgccagugagcacggccuugucuauuacacuugaccccuccacugucacacccacaacaccagccaguggauuagaaggcucaggggaagucuacacauccccuccgaucaccaccgggagcuugccccugucggagacaacaccagaacucccuguuacaaccggcacagacaccuuaagcgcaggugaugucgaucccagcacgcagacagccggaggcaccuccgcaccaacaguccgcacaagucuacccaacagcccuagcacaccaucuacaccacaagacacacaccauccugugagaaaucuacuuucagucacgaguccugggccagaugaaacaucaacacccucgggaacaggcaaagagagcucagcaaccaguagcccucauccagucuccaacagaccaccaaccccuccugcaacagcccagggacccacugaaaaugacagucacaacgccacugaacacccugagucccugacacagucagcaaccccaggccuaaugaccucuccaacacagauaguccacccacaaagugccacccccauaaccguucaagacacacaucccaguccaacgaacaggucuaaaagaaaccuuaagauggaaauaaucuugacuuuaucucaggguuuaaaaaaguacuaugggaaaauauuaaggcuucugcaacucaccuuagaggaggacacugaaggucuacuggaaugguguaagagaaaucuuggucuugauugugaugacacuuucuuucaaaagagaauugaagaauucuuuauaacuggugagggccauuuuaaugaaguuuuacaauuuagaacgccaggcacguugagcaccacagagucaacaccugcugggcugccaacagcugaaccuuuuaaguccuacuucgccaaaggcuuccucucgauagauucagguuacuacucagccaaauguuacucaggaacauccaauucagggcuucaauugauuaacauuacccgacauucaacuagaauaguugacacaccugggccuaagaucacuaaccuaaagaccaucaacugcauaaacuugaaggcaucgaucuucaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucaucccaggaacuuacaaaauagugauagauaaaaaaaauaaguugaaugacagaugcaccuuauuuaccgacugugugauaaaaggaagggagguucguaaaggacagucaguuuugaggcaguacaagacggaaaucaggauuggcaaggcaucaaccggcuuuagaagauugcuuucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17015 - RNA, 5437 nt, Artificial Sequence
  mRNA product Design2 comprising derived and/or modified sequence from CCHFV(10200)__U39455.2__GP (wt)
ggggcgcugccuacggagguggcagccaucuccuucucggcaucaagcuuaccaugcauauaucauuaauguaugcaauccuuugccuacagcuguguggucugggagagacucauggaucacacaaugaaacuagacacaauaaaacagacaccaugacaacacacggugauaacccgagcucugaaccgccagugagcacggccuugucuauuacacuugaccccuccacugucacacccacaacaccagccaguggauuagaaggcucaggggaagucuacacauccccuccgaucaccaccgggagcuugccccugucggagacaacaccagaacucccuguuacaaccggcacagacaccuuaagcgcaggagaugucgaucccagcacgcagacagccggaggcaccuccgcaccaacaguccgcacaagucuacccaacagcccuagcacaccaucuacaccacaagacacacaccauccugugagaaaucuacuuucagucacgaguccugggccagaugaaacaucaacacccucgggaacaggcaaagagagcucagcaaccaguagcccucauccagucuccaacagaccaccaaccccuccugcaacagcccagggacccacugaaaaugacagucacaacgccacugaacacccugagucccugacacagucagcaaccccaggccuaaugaccucuccaacacagauaguccacccacaaagugccacccccauaaccguucaagacacacaucccaguccaacgaacaggucuaaaagaaaccuuaagauggaaauaaucuugacuuuaucucaggguuuaaaaaaguacuaugggaaaauauuaaggcuucugcaacucaccuuagaggaggacacugaaggucuacuggaaugguguaagagaaaucuuggucuugauugugaugacacuuucuuucaaaagagaauugaagaguucuuuauaacuggugagggccauuuuaaugaaguuuuacaauuuagaacgccaggcacguugagcaccacagagucaaccccugcugggcugccaacagcugaaccuuuuaaguccuacuucgccaaaggcuuccucucgauagauucagguuacuacucagccaaauguuacucaggaacauccaauucagggcuucaauugauuaacauuacccgacauucaacuagaauaguugacacaccugggccuaagaucacuaaccuaaagaccaucaacugcauaaacuugaaggcaucgaucuucaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucaucccaggaacuuacaaaauagugauagauaaaaaaaauaaguugaaugacagaugcaccuuauuuaccgacugugugauaaaaggaagggagguucguaaaggacagucaguuuugaggcaguacaagacggaaaucaggauuggcaaggcaucaaccggcuuuagaagauugcuuucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17016 - RNA, 5437 nt, Artificial Sequence
  mRNA product Design2 comprising derived and/or modified sequence from CCHFV(IbAr10200)__AF467768.2__GP (wt)
ggggcgcugccuacggagguggcagccaucuccuucucggcaucaagcuuaccaugcauauaucauuaauguaugcaauccuuugccuacagcuguguggucugggagagacucauggaucacacaaugaaacuagacacaauaaaacagacaccaugacaacacccggugauaacccgagcucugaaccgccagugagcacggccuugucuauuacacuugaccccuccacugucacacccacaacaccagccaguggauuagaaggcucaggggaagucuacacauccccuccgaucaccaccgggagcuugccccugucggagacaacaccagaacucccuguuacaaccggcacagacaccuuaagcgcaggugaugucgaucccagcacgcagacagccggaggcaccuccgcaccaacaguccgcacaagucuacccaacagcccuagcacaccaucuacaccacaagacacacaccauccugugagaaaucuacuuucagucacgaguccugggccagaugaaacaucaacacccucgggaacaggcaaagagagcucagcaaccaguagcccucauccagucuccaacagaccaccaaccccuccugcaacagcccagggacccacugaaaaugacagucacaacgccacugaacacccugagucccugacacagucagcaaccccaggccuaaugaccucuccaacacagauaguccacccacaaagugccacccccauaaccguucaagacacacaucccaguccaacgaacaggucuaaaagaaaccuuaagauggaaauaaucuugacuuuaucucaggguuuaaaaaaguacuaugggaaaauauuaaggcuucugcaacucaccuuagaggaggacacugaaggucuacuggaaugguguaagagaaaucuuggucuugauugugaugacacuuucuuucaaaagagaauugaagaauucuuuauaacuggugagggccauuuuaaugaaguuuuacaauuuagaacgccaggcacguugagcaccacagagucaacaccugcugggcugccaacagcugaaccuuuuaaguccuacuucgccaaaggauuccucucgauagauucagguuacuacucagccaaauguuacucaggaacauccaauucagggcuucaauugauuaacauuacccgacauucaacuagaauaguugacacaccugggccuaagaucacuaaccuaaagaccaucaacugcauaaacuugaaggcaucgaucuucaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucaucccaggaacuuacaaaauagugauagauaaaaaaaauaaguugaaugacagaugcaccuuauuuaccgacugugugauaaaaggaagggagguucguaaaggacagucaguuuugaggcaguacaagacggaaaucaggauuggcaaggcaucaaccggcucuagaagauugcuuucagaagaacccagugaugacuguauaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggccauuuuuuacuuguuaauaauuguuggaacacuagggaaaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaaaaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacaggugggagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuggcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauagaagaauugccgaacuguucucuacaaaaacacacauuggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17017 - RNA, 5437 nt, Artificial Sequence
  mRNA product Design2 comprising derived and/or modified sequence from CCHFV(IbAr10200)__AF467768.2__GP (wt)
ggggcgcugccuacggagguggcagccaucuccuucucggcaucaagcuuaccaugcauauaucauuaauguaugcaauccuuugccuacagcuguguggucugggagagacucauggaucacacaaugaaacuagacacaauaaaacagacaccaugacaacacccggugauaacccgagcucugaaccgccagugagcacggccuugucuauuacacuugaccccuccacugucacacccacaacaccagccaguggauuagaaggcucaggggaagucuacacauccccuccgaucaccaccgggagcuugccccugucggagacaacaccagaacucccuguuacaaccggcacagacaccuuaagcgcaggagaugucgaucccagcacgcagacagccggaggcaccuccgcaccaacaguccgcacaagucuacccaacagcccuagcacaccaucuacaccacaagacacacaccauccugugagaaaucuacuuucagucacgaguccugggccagaugaaacaucaacacccucgggaacaggcaaagagagcucagcaaccaguagcccucauccagucuccaacagaccaccaaccccuccugcaacagcccagggacccacugaaaaugacagucacaacgccacugaacacccugagucccugacacagucagcaaccccaggccuaaugaccucuccaacacagauaguccacccacaaagugccacccccauaaccguucaagacacacaucccaguccaacgaacaggucuaaaagaaaccuuaagauggaaauaaucuugacuuuaucucaggguuuaaaaaaguacuaugggaaaauauuaaggcuucugcaacucaccuuagaggaggacacugaaggucuacuggaaugguguaagagaaaucuuggucuugauugugaugacacuuucuuucaaaagagaauugaagaguucuuuauaacuggugagggccauuuuaaugaaguuuuacaauuuagaacgccaggcacguugagcaccacagagucaaccccugcugggcugccaacagcugaaccuuuuaaguccuacuucgccaaaggauuccucucgauagauucagguuacuacucagccaaauguuacucaggaacauccaauucagggcuucaauugauuaacauuacccgacauucaacuagaauaguugacacaccugggccuaagaucacuaaccuaaagaccaucaacugcauaaacuugaaggcaucgaucuucaaagaacauagagagguugaaaucaaugugcuucucccccaaguugcaguuaaucucucaaacugucacguuguaaucaaaucacaugucugugacuacucuuuagacauugacggugcggugaggcuuccucacauuuaccaugaaggaguuuucaucccaggaacuuacaaaauagugauagauaaaaaaaauaaguugaaugacagaugcaccuuauuuaccgacugugugauaaaaggaagggagguucguaaaggacagucaguuuugaggcaguacaagacggaaaucaggauuggcaaggcaucaaccggcucuagaagauugcuuucagaagaacccagugaugacuguauaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggccauuuuuuacuuguuaauaauuguuggaacacuagggaaaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaaaaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacaggugggagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuggcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauagaagaauugccgaacuguucucuacaaaaacacacauuggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17018 - RNA, 5449 nt, Artificial Sequence
  mRNA product Design2 comprising derived and/or modified sequence from CCHFV(Turkey-Kelkit06)__GQ337054.1__GP (wt)
ggggcgcugccuacggagguggcagccaucuccuucucggcaucaagcuuaccaugcccaccaacauuaugcauacaccauuagugugcuucauucuuuaccuacagcuguugugucuaggaggagcucaugggcaguuaaacgcaacugaacacaauggaacaaacaacaccacagcaccuggcgcaagccaaagccccaagccacccaugagcacaaccccaccacacgcaccggaaucauccaccaucaaacccaccacaccaauaagcgaagcagaaggcucaggggaaacgaccucacccccaaacaccacccagggccuguccucgccagagaccacaucagaacgcccugcaacaaccuccaucagcacgucaagcacagacagcacgaaccccaccacacagaugaccgacaacacccccacaccaacagucagcacaagcccauccagcagccccagcacgccauccacaccacaaggcauacaucauccugcaaggagucuguugucagucucgagccccaagacaguaacaacaccaacaccaacgagcccuggagagaugagcucggaaaccagcagucagcacucagccaugagcagaauaccaaccccccacacagcaacccgggucuccacugagaucaccaaccaccgcacaccuagacaaucugaauccucagcacagcagacaaccccaagcccaaugacuuccccagcgcaaucgauccuucuaaugagugcugcuccuacagcuguucaagacauacaucccagcccaacaaacaggucuaagaggaaccuugagacggaaauaauuuuaacucuaucucaaggucuaaagaaauacuacgguaagauacugaagcuucugcaccucaccuuagaacaggacaccgaaggccugcuagaaugguguaagggaaaccuugggucaaacugugaugaugacuucuuucaaaagagaauagaagaauucuucaugacuggugagugcuacuucaaugaagucuuacaauuuaaaacacuaagcacacuaagccccacggagccgucucaugccaggcuaccaacagcagaacccuucaaaucuuacuuugcuaagggcuuccuuucaauagauucagguuacuucucugccaaauguuauccaagaucaucugcuucagggcuucagcugaucaauguuacccaacacccagcuaggauagcagaaacaccuggacccaagacaacaagucugaaaaccaucaacuguauaaaccuaagagcaucagucuucaaagaacacagagaaguugagaucaaugugcuucuuccucagauugcagucaaccucucaaacugccauguugugaucaauucacaugucugugauuacucuuuagacacugaugggccagugaggcuuccucgcauuuaucaugaagggacuuucauaccaggaacuuauaaaauagugauagacaaaaaaaauaagcuaaaugaccguuguacacuggucaccaacugugugauaaagggaagagagguucguaaggggcaaucagugcugaggcaguacaaaacagaaaucaagauaggcaaggcaucaacaggcuuuaggaaacuacuguccgaagagccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcaaaaacagcgccacagggaaaaccugugagguagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggggauauccuaguggacuguucaggugggcagcaacauuucuuaaaagacaacuuaauugaccuagggugcccccauaucccgcuauuggguaggauggcuauuuacauuugcagaaugucaaaucauccuagaacaaccauggcuuuucucuucugguucagcuuuggcuauguuaucacuuguauauuuugcaaggcucuuuuuuauucauugauaauuauuggaacacuaggaaaaaagaucaagcaauauagggaacugaaaccucaaaccugcaccauaugugagacagcuccugucaaugcaauagaugcugaaaugcaugaccucaacuguaguuacaauauaugcccuuauugugcaucaagauugaccuccgaugggcuagccaggcauguaacgcaaugccccaagcggaaagagaaaguugaggagacugaacuguaccugaaccuggaaagaauuccuuggauugucagaaagcuauugcaggugucagaguccacugguguggcauugaaacgaagcagcuggcugauuguacugcuuguguuacugacaguuucguugucgccgguucagucagcaccuguuggucauggaaagacaaucgaaauauaucagaccagggaaggauucgcaagcaucugucucuuuauguuaggaagcauucuauuuauagucucuugcuuggugaaagggcuaguugacagugucagugaaagcuucuuccccggccuaucugucuguaagacaugcucuauuggcaguguaaauggcuuugaaauugaaucgcacaaaugcuacuguagccuauuuugcugccccuacuguaggcacugcucugcugacagagaaauucaccaguuacacuugaguaucugcaaaaaaaggaaaacggggagcaaugucaugcuggccgucugcaaacgcaugugcuuuagggcaaccauagaagcaagcagaagagcccugcucauccgaagcauuaucaauaccacuuuuguaauaugcauucuaacauugacaaucuguguuguuagcaccucugcaguggagauggaaaaccuuccagcaggaacuugggagagggaggaagaucugacaaauuucugucaucaggaaugccaggugacugagacagaaugccucuguccauacgaagcucuugugcucagaaaaccucuuuucuuggacaguauaguuaaagguaugaaaaauuugcuaaacucaacaagcuuggaaacaagcuuaucaauugaggcaccauggggagcaauaaauguccaaucaaccuuuaaaccaacuguaucgacugcaaacauagcacucaguuggagcucaguggugcacagaggcaacaagaucuuggucacaggcaggucugaaucaauuaugaaacuggaggaaaggacaggagucagcugggaucuaggcguagaagaugccucugaauccaaauuacuuaccguuucuaucauggauuugucacaaauguauucuccuguuuuugaguacuugucaggagacagacagguugaagaauggcccaaagcaacuuguacaggugauugcccggaaaggugugguugcacaucaucaaccugcuuacauaaagaauggucucacucaagaaacuggagauguaaucccacuuggugcuggggaguaggaaccggcugcaccugcugcgggguggauguaaaagaucuuuuuaccgaucacauguuugucaaauggaaaguugaauacauaaaaacugaagcuauaguauguguugcgcucaccagccaagaaagacagugcagucugauugaggcagguacuagauucaacuugggcccugugacuauuacccugucugagccaagaaacauucagcagaagcuuccuccugagauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaucacauuucaacaccucuuggauguccugggaugguugugacuuagacuacuacugcaacaugggggauuggccaucuugcacauacacaggagugacccagcauaaccaugcugcauuuguaaacuugcuuaacauugaaacugauuacacgaaaaccuuccacuuccacucuaaaagagucacagcacauggugacacaccacaauuggacuuaaaagcaaggccgaccuacggugcaggugggaucacugugcugguugagguugcugacauggaguugcauaccaagaaaguugaaauaucaggcuugaaauuugcaagucuggcuugcacggguugcuaugcuuguagcucuggcaucuccuguaaaguuaggauucauguagaugaaccagaugagcucacaguacauguaaagagcagugauccagaugugguugcagcuagcacaagucucauggcgaggaagcuugaauuugggacagacagcacauucaaggccuuuucagcuaugcccaaaaccucucuauguuuuuacauuguggagagagaauacugcaagagcugcagugaagaugauacacaaaaauguguugacacaagacuugagcagccacagagcauacuaauugagcacaaaggaacgauaauuggaaagcagaaugauacuugcacagccaaggcaagcuguuggcuagagucagucaagaguuuuuuuuauggauugaagaauaugcuuggcaguguuuuugguaaucuuuucauaggcauuuuguuauuccuugccccuuuuguccuguuggugcuuuucuuuauguuuggguggaaaaucuuguuuugcuuuaaauguugcaggaggaccagaggcuuauuuaaguauagacaccucaaagacgaugaggaaacaggcuacagaaggauuauugaaagacugaacagcaaaaaagggaaaaacaggcugcuugauggugauagacuggcugauaggaaaauugcugagcuguucuccacaaaaacacacauuggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17019 - RNA, 5449 nt, Artificial Sequence
  mRNA product Design2 comprising derived and/or modified sequence from CCHFV(Turkey-Kelkit06)__GQ337054.1__GP (wt)
ggggcgcugccuacggagguggcagccaucuccuucucggcaucaagcuuaccaugcccaccaacauuaugcauacaccauuagugugcuucauucuuuaccuacagcuguugugucuaggaggagcucaugggcaguuaaacgcaacugaacacaauggaacaaacaacaccacagcaccuggcgcaagccaaagccccaagccacccaugagcacaaccccaccacacgcaccggaaucauccaccaucaaacccaccacaccaauaagcgaagcagaaggcucaggggaaacgaccucacccccaaacaccacccagggccuguccucgccagagaccacaucagaacgcccugcaacaaccuccaucagcacgucaagcacagacagcacgaaccccaccacacagaugaccgacaacacccccacaccaacagucagcacaagcccauccagcagccccagcacgccauccacaccacaaggcauacaucauccugcaaggagucuguugucagucucgagccccaagacaguaacaacaccaacaccaacgagcccuggagagaugagcucggaaaccagcagucagcacucagccaugagcagaauaccaaccccccacacagcaacccgggucuccacugagaucaccaaccaccgcacaccuagacaaucugaauccucagcacagcagacaaccccaagcccaaugacuuccccagcgcaaucgauccuucuaaugagugcugcuccuacagcuguucaagacauacaucccagcccaacaaacaggucuaagaggaaccuugagacggaaauaauuuuaacucuaucucaaggucuaaagaaauacuacgguaagauacugaagcugcugcaccucaccuuagaacaggacaccgaaggccugcuagaaugguguaagggaaaccuugggucaaacugugaugaugacuucuuucaaaagagaauagaagaguucuucaugacuggugagugcuacuucaaugaagucuuacaauuuaaaacacuaagcacacuaagccccacggagccgucucaugccaggcuaccaacagcagaacccuucaaaucuuacuuugcuaagggcuuccuuucaauagauucagguuacuucucugccaaauguuauccaagaucaucugcuucagggcuucagcugaucaauguuacccaacacccagcuaggauagcagaaacaccuggacccaagacaacaagucugaaaaccaucaacuguauaaaccuaagagcaucagucuucaaagaacacagagaaguugagaucaaugugcuucuuccucagauugcagucaaccucucaaacugccauguugugaucaauucacaugucugugauuacucuuuagacacugaugggccagugaggcuuccucgcauuuaucaugaagggacuuucauaccaggaacuuauaaaauagugauagacaaaaaaaauaagcuaaaugaccguuguacacuggucaccaacugugugauaaagggaagagagguucguaaggggcaaucagugcugaggcaguacaaaacagaaaucaagauaggcaaggcaucaacaggcuuuaggaaacuacuguccgaagaaccaggugaugacugcauaucaagaacucagcuauugaggacagaaacagcagagauccaugaugacaacuauggugguccaggugauaaaauaacuaucugcaacgguucaaccauuguagaucagagacugggcagugaacuaggguguuauaccaucaacagggugaagucauucaagcuaugcaaaaacagcgccacagggaaaaccugugagguagacagcacuccgguuaagugcaggcaagguuuuuguuuaaaaaucacccaagagggaaggggccacguaaaauuaucuagaggcucagagguuguccuggaugcuugcgacucaagcugugaaguaaugauaccuaaaggcacuggggauauccuaguggacuguucaggugggcagcaacauuucuuaaaagacaacuuaauugaccuagggugcccccauaucccgcuauuggguaggauggcuauuuacauuugcagaaugucaaaucauccuagaacaaccauggcuuuucucuucugguucagcuuuggcuauguuaucacuuguauauuuugcaaggcucuuuuuuauucauugauaauuauuggaacacuaggaaaaaagaucaagcaauauagggaacugaaaccucaaaccugcaccauaugugagacagcuccugucaaugcaauagaugcugaaaugcaugaccucaacuguaguuacaauauaugcccuuauugugcaucaagauugaccuccgaugggcuagccaggcauguaacgcaaugccccaagcggaaagagaaaguugaggagacugaacuguaccugaaccuggaaagaaucccuuggauugucagaaagcuauugcaggucucagaguccacugguguggcauugaaacgaagcagcuggcugauuguacugcuuguguuacugacaguuucguugucgccgguucagucagcaccuguuggucauggaaagacaaucgaaauauaucagaccagggaaggauucgcaagcaucugucucuuuauguuaggaagcauucuauuuauagucucuugcuuggugaaagggcuaguugacagugucagugagagcuucuuccccggccuaucugucuguaagacaugcucuauuggcaguguaaauggcuuugaaauugaaucgcacaaaugcuacuguagccuauuuugcugccccuacuguaggcacugcucugcugacagagaaauucaccaguuacacuugaguaucugcaaaaaaaggaaaacggggagcaaugucaugcuggccgucugcaaacgcaugugcuuuagggcaaccauagaagcaagcagaagggcccugcucauccgaagcauuaucaauaccacuuuuguaauaugcauucuaacauugacaaucuguguuguuagcaccucugcaguggagauggaaaaccuuccagcaggaacuugggagagggaggaagaucugacaaauuucugucaucaggaaugccaggugacugagacagaaugccucuguccauacgaagcucuugugcucagaaaaccucuuuucuuggacaguauaguuaaagguaugaaaaauuugcuaaacucaaccagcuuggaaaccagcuuaucaauugaggcaccauggggagcaauaaauguccaaucaaccuuuaaaccaacuguaucgacugcaaacauagcacucaguuggagcucaguggugcacagaggcaacaagaucuuggucacaggcaggucugaaucaauuaugaaacuggaggaaaggacaggagucagcugggaucuaggcguagaagaugccucugaauccaaauuacuuaccguuucuaucauggauuugucacaaauguauucuccuguuuuugaguacuugucaggagacagacagguugaagaauggcccaaagcaacuuguacaggugauugcccggaaaggugugguugcacaucaucaaccugcuuacauaaagaauggucucacucaagaaacuggagauguaaucccacuuggugcuggggaguaggaaccggcugcaccuguugcgggguggauguaaaagaucuuuuuaccgaucacauguuugucaaauggaaaguugaauacauaaaaacugaagcuauaguauguguugcgcucaccagccaagaaagacagugcagucugauugaggcagguacuagauucaacuugggcccugugacuauuacccugucugagccaagaaacauucagcagaagcugccuccugagauuaucacguugcaucccaaaauugaagaaggcuucuuugacuugaugcauguacaaaaaguguugucugcaaguacaguguguaaacugcagaguugcacacaugguauaccaggagaucuacaaguuuaccacauuggcaacuuguugaaaggggauagaguaaacgggcaucuaauucacaaaauugaaucacauuucaacaccucuuggauguccugggaugguugugacuuagacuacuacugcaacaugggggauuggccaucuugcacauacacaggagugacccagcauaaccaugcugcauuuguaaacuugcuuaacauugaaacugauuacacgaaaaccuuccacuuccacucuaaaagagucacagcacauggugacacaccacaauuggacuuaaaagcaaggccgaccuacggugcaggagggaucacugugcugguugagguugcugacauggaguugcauaccaagaaaguugaaauaucaggcuugaaauuugcaagucuggcuugcacggguugcuaugcuuguagcucuggcaucuccuguaaaguuaggauucauguagaugaaccagaugagcucacaguacauguaaagagcagugauccagaugugguugcagcuagcacaagucucauggcgaggaagcuggaauuugggacagacagcacauucaaggccuuuucagcuaugcccaaaaccucucuauguuuuuacauuguggagagagaauacugcaagagcugcagugaagaugauacacaaaaauguguugacacaagacuugagcagccacagagcauacuaauugagcacaaaggaacgauaauuggaaagcagaaugauacuugcacagccaaggcaagcuguuggcuagagucagucaagaguuuuuuuuauggauugaagaauaugcuuggcaguguuuuugguaaucuuuucauaggcauuuuguuauuccuugccccuuuuguccuguuggugcuuuucuuuauguuuggguggaaaaucuuguuuugcuuuaaauguugcaggaggaccagaggcuuauuuaaguauagacaccucaaagacgaugaggaaacaggcuacagaaggauuauugaaagacugaacagcaaaaaagggaaaaacaggcugcuugauggugauagacuggcugauaggaaaauugcugagcuguucuccacaaaaacacacauuggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17020 - RNA, 3961 nt, Artificial Sequence
  mRNA product Design2 comprising derived and/or modified sequence from CCHVF(10200)__U39455.2__SP-GP_Gn-NSm-Gc (wt)
ggggcgcugccuacggagguggcagccaucuccuucucggcaucaagcuuaccaugcauauaucauuaauguaugcaauccuuugccuacagcuguguggucugggagagacucauggaucacacaaugaaacuucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17021 - RNA, 3961 nt, Artificial Sequence
  mRNA product Design2 comprising derived and/or modified sequence from CCHVF(10200)__U39455.2__SP-GP_Gn-NSm-Gc (wt)
ggggcgcugccuacggagguggcagccaucuccuucucggcaucaagcuuaccaugcauauaucauuaauguaugcaauccuuugccuacagcuguguggucugggagagacucauggaucacacaaugaaacuucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17022 - RNA, 3934 nt, Artificial Sequence
  mRNA product Design2 comprising derived and/or modified sequence from CCHVF(10200)__U39455.2__IgE-leader_Gn-NSm-Gc (wt)
ggggcgcugccuacggagguggcagccaucuccuucucggcaucaagcuuaccauggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17023 - RNA, 3934 nt, Artificial Sequence
  mRNA product Design2 comprising derived and/or modified sequence from CCHVF(10200)__U39455.2__IgE-leader_Gn-NSm-Gc (wt)
ggggcgcugccuacggagguggcagccaucuccuucucggcaucaagcuuaccauggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauuggucaagggaagacaauugaggcauaccgggccagggaaggguacacaaguauaugccucuuuguacuaggaaguauccuauuuauaguuucuugccuaaugaaagggcugguugacaguguuggcaacuccuucuucccuggacuguccauuugcaaaacgugcuccauaagcagcauuaauggcuuugaaauugagucccauaagugcuauugcagcuuauucuguugccccuauuguaggcacugcucuaccgauaaagaaauucauaagcugcacuugagcaucugcaaaaaaaggaaaacaggaaguaaugucauguuggcugucugcaagcucauguguuucagggccaccauggaaguaaguaacagagcccuguuuauccguagcaucaucaacaccacuuuuguuuugugcauacugauacuagcaguuuguguuguuagcaccucagcaguggagauggaaaaccuaccagcagggaccugggaaagagaagaagaccuaacaaauuucugucaucaggaaugccagguuacagagacugaaugccucugcccuuaugaagcucuaguacucagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17024 - RNA, 3355 nt, Artificial Sequence
  mRNA product Design2 comprising derived and/or modified sequence from CCHVF(10200)__U39455.2__IgE-leader_Gn-4aa-Gc (wt)
ggggcgcugccuacggagguggcagccaucuccuucucggcaucaagcuuaccauggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauugguagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17025 - RNA, 3355 nt, Artificial Sequence
  mRNA product Design2 comprising derived and/or modified sequence from CCHVF(10200)__U39455.2__IgE-leader_Gn-4aa-Gc (wt)
ggggcgcugccuacggagguggcagccaucuccuucucggcaucaagcuuaccauggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauugguagaaagccuuuauuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17026 - RNA, 1411 nt, Artificial Sequence
  mRNA product Design2 comprising derived and/or modified sequence from CCHVF(10200)__U39455.2__IgE-leader_Gn (wt)
ggggcgcugccuacggagguggcagccaucuccuucucggcaucaagcuuaccauggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaauuccuuggguuguaagaaagcuguugcaggugucagagucaacugguguggcauugaaaagaagcaguuggcugauugugcugcuugugcuauucacuguuucauuaucaccaguucaaucagcacccauugguuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17027 - RNA, 1411 nt, Artificial Sequence
  mRNA product Design2 comprising derived and/or modified sequence from CCHVF(10200)__U39455.2__IgE-leader_Gn (wt)
ggggcgcugccuacggagguggcagccaucuccuucucggcaucaagcuuaccauggacuggaccuggauccuguuccucguggccgccgcgacccgcguccacagcucagaagaacccagugaugacuguguaucaagaacucaacuauuaaggacagagacugcagagauccacggcgacaacuaugguggcccgggugacaaaauaaccaucugcaauggcucaacuauuguagaccaaagacugggcagugaacuaggaugcuacaccaucaauagagugaggucauucaagcuaugcgaaaacagugccacagggaagaauugugaaauagacagugucccaguuaaaugcaggcaggguuauugccuaagaaucacucaggaagggaggggccacguaaaauuaucuaggggcucagagguugucuuagaugcaugcgauacaagcugugaaauaaugauaccuaagggcacuggugacauccuaguugacuguucaggugggcagcaacauuuucuaaaggacaauuugauagaucuaggaugccccaaaauuccauuauugggcaaaauggcuauuuacauuugcagaaugucaaaccaccccaaaacaaccauggcuuuccucuucugguucagcuuuggcuauguaauaaccugcauacuuugcaaggcuauuuuuuacuuguuaauaauuguuggaacacuagggagaaggcucaagcaguauagagaguugaaaccucagacuugcaccauaugugagacaacuccuguaaaugcaauagaugcugagaugcaugaccucaauugcaguuacaacauuugucccuacugugcaucuagacuaaccucagaugggcuugcuaggcaugugauacaaugcccuaagcggaaggagaaaguggaagaaacugaacuguacuugaacuuagaaagaaucccuuggguuguaagaaagcuguugcaggucucagagucaacugguguggcauugaaaagaagcaguuggcugauugugcugcuugugcuauucacuguuucauuaucaccaguucaaucagcacccauugguuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17028 - RNA, 2371 nt, Artificial Sequence
  mRNA product Design2 comprising derived and/or modified sequence from CCHVF(10200)__U39455.2__IgE-leader_Gc (wt)
ggggcgcugccuacggagguggcagccaucuccuucucggcaucaagcuuaccauggacuggaccuggauccuguuccucguggccgccgcgacccgcguccacagcuuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacuagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugcaagcuuagcuugcacagguuguuaugcuuguagcucuagcaucucaugcaaaguuagaauucauguggaugaaccagaugaacuuacaguacauguuaaaagugaugauccagaugugguugcagcuagcucaagucucauggcaaggaagcuugaauuuggaacagacaguacauuuaaagcuuucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17029 - RNA, 2371 nt, Artificial Sequence
  mRNA product Design2 comprising derived and/or modified sequence from CCHVF(10200)__U39455.2__IgE-leader_Gc (wt)
ggggcgcugccuacggagguggcagccaucuccuucucggcaucaagcuuaccauggacuggaccuggauccuguuccucguggccgccgcgacccgcguccacagcuuccuagauaguacagcuaaaggcaugaaaaaucugcuaaauucaacaaguuuagaaacgaguuuaucaauugaggcaccauggggagcaauaaauguucagucaaccuacaaaccaacugugucaacugcaaacauagcacucaguuggagcucaguggaacacagaggcaauaagaucuugguuucaggcagaucagaaucaauuaugaagcuggaagaaaggacaggaaucagcugggaucucgguguagaagaugccucugaaucuaaacugcuuacaguaucugucauggacuugucucagauguacucuccugucuucgaguacuuaucaggggacagacagguggaagaguggcccaaagcaacuugcacaggugacugcccagaaagauguggcugcacaucaucaaccuguuugcacaaagaauggccucacucaagaaauuggagaugcaaucccacuuggugcugggguguagggacuggcugcaccuguuguggauuagaugugaaagaccuuuuuacagauuauauguuugucaaguggaaaguugaauacaucaagacagaggccauaguguguguagaacuuacaagucaggaaaggcaguguagcuugauugaagcgggcacaagguucaauuuagguccugugaccaucacacugucagaaccaagaaacauccaacaaaaacucccuccugaaauaaucacacugcauccuaggaucgaagaagguuuuuuugaccugaugcaugugcaaaagguguuaucggcaagcacaguguguaaguugcagaguugcacacauggugugccaggagaccuacaggucuaccacaucggaaauuuauuaaaaggggauaagguaaauggacaucuaauucauaaaauugagccacacuucaacaccuccuggauguccugggaugguugugaccuagacuacuacugcaacaugggagauuggccuucuugcacauacacaggggucacccaacacaaucaugcuucauuuguaaacuuacucaacauugaaacugauuacacaaagaacuuccacuuucacucuaaaagggucacugcacacggagauacaccacaacuagaucuuaaggcaagaccaaccuauggugcaggcgagaucacuguucugguagaaguugcugacauggaguuacauacaaagaagauugaaauaucaggcuuaaaauuugccagcuuagcuugcacagguuguuaugcuuguagcucuagcaucucaugcaaaguuagaauccauguggaugaaccagaugaacuuacaguacauguuaaaagugaugauccagaugugguugcagcuagcucaagucucauggcaaggaagcuggaauuuggaacagacaguacauuuaaagcauucucggccaugccuaaaacuucucuauguuucuacauuguugaaagagaacacuguaagagcugcagugaagaagacacaaaaaaauguguuaacacaaaacuugagcaaccacaaagcauuuugaucgaacacaagggaacuauaaucggaaagcaaaacagcacuugcacggcuaaggcaaguugcugguuagagucagucaagaguuuuuuuuauggccuaaagaacaugcuuaguggcauuuuuggcaaugucuuuaugggcauuuucuuguuccuugcccccuucauccuguuaauacuauucuuuauguuuggguggaggauccuauucugcuuuaaauguuguagaagaaccagaggccuguucaaguauagacaccucaaagacgaugaagaaacugguuauagaaggauuauugaaaaacuaaacaauaaaaaaggaaaaaacaaacugcuugauggugaaagacuugcugauggaagaauugccgaacuguucucuacaaaaacacacauuggcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17030 - RNA, 1831 nt, Artificial Sequence
  mRNA product Design2 comprising derived and/or modified sequence from CCHFV(10200)__NC_005302.1/U88410.1__N (opt4)
ggggcgcugccuacggagguggcagccaucuccuucucggcaucaagcuuaccauggagaacaagaucgaggugaacaacaaggacgagaugaacagaugguucgaggaguucaagaagggcaacggccugguggacaccuucaccaacagcuacagcuucugcgagagcgugcccaaccuggacagauucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaagaacgccggcaccaucaagagcugggacgagagcuacaccgagcugaagguggacgugcccaagaucgagcagcugaccggcuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagccacgagcacguggacuggugcagagaguucgugaagggcaaguacaucauggccuucaacccccccuggggcgacaucaacaagagcggcagaagcggcaucgcccugguggccaccggccuggccaagcuggccgagaccgagggcaagggcaucuucgacgaggccaagaagaccguggaggcccugaacggcuaccuggacaagcacaaggacgagguggacagagccagcgccgacagcaugaucaccaaccugcugaagcacaucgccaaggcccaggagcuguacaagaacagcagcgcccugagagcccagagcgcccagaucgacaccgccuucagcagcuacuacuggcuguacaaggccggcgugacccccgagaccuuccccaccgugagccaguuccuguucgagcugggcaagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccaacaccgagaccaacaaccccugcgccaagaccaucgugaagcuguucgaggugcagaagaccggcuucaacauccaggacauggacaucguggccagcgagcaucugcugcaccagagccuggugggcaagcagagccccuuccagaacgccuacaacgugaagggcaacgccaccagcgccaacaucaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17031 - RNA, 1831 nt, Artificial Sequence
  mRNA product Design2 comprising derived and/or modified sequence from CCHFV(Turkey-Kelkit06)__GQ337053.1__N (opt4)
ggggcgcugccuacggagguggcagccaucuccuucucggcaucaagcuuaccauggagaacaagaucgaggugaacagcaaggacgagaugaacaagugguucgaggaguucaagaagggcaacggccugauggacaccuucaccaacagcuacagcuucugcgagaacgugcccaaccuggacaaguucguguuccagauggccagcgccaccgacgacgcccagaaggacagcaucuacgccagcgcccugguggaggccaccaaguucugcgcccccaucuacgagugcgccugggugagcagcaccggcaucgugaagaagggccuggagugguucgagaaggacagcggcaccaucaagagcugggacgagaacuacgccgagcugaagguggacgugcccaagaucgagcagcuggccaacuaccagcaggccgcccugaaguggagaaaggacaucggcuucagagugaacgccaacaccgccgcccugagcaacaaggugcuggccgaguacaaggugcccggcgagaucgugaugagcgugaaggagaugcugagcgacaugaucagaagaagaaaccugauccugaacagaggcggcgacgagaaccccagaggccccgugagcagagagcacguggaguggugcagagaguucgugaagggcaaguacaucauggccuucaacccccccuggggcgacaucaacaagagcggcagaagcggcaucgcccugguggccaccggccuggccaagcuggccgagaccgagggcaagggcguguucgacgaggccaagaagaccguggaggcccugaacggcuaccuggacaagcacagagacgagguggacaaggccagcgccgacagcaugaucaccaaccugcccaagcacaucgccaaggcccaggagcuguacaagaacagcagcgcccugagagcccagggcgcccagaucgacacccccuucagcagcuucuacuggcuguacaaggccggcgugacccccgagaccuuccccaccaucagccaguuccuguucgagcugggcgagcagcccagaggcaccaagaagaugaagaaggcccugcugagcacccccaugaaguggggcaagaagcuguacgagcuguucgccgacgacagcuuccagcagaacagaaucuacaugcaccccgccgugcugaccgccggcagaaucagcgagaugggcgugugcuucggcaccauccccguggccaaccccgacgacgccgcccagggcagcggccacaccaagagcauccugaaccugagaaccagcaccgagaccaacaaccccugcgccaagaccaucgugaagcuguucgagauccaggagaccggcuucaacauccaggacauggacaucguggccagcgagcaucugcugcaccagagcaucgugggcaagcagagccccuuccagaacgccuacaacgugaagggcaacgccaccagcgccaacaucaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17032 - RNA, 5437 nt, Artificial Sequence
  mRNA product Design2 comprising derived and/or modified sequence from CCHFV(10200)__U39455.2__GP (opt4)
ggggcgcugccuacggagguggcagccaucuccuucucggcaucaagcuuaccaugcacaucagccugauguacgccauccugugccugcagcugugcggccugggcgagacccacggcagccacaacgagaccagacacaacaagaccgacaccaugaccacccacggcgacaaccccagcagcgagccccccgugagcaccgcccugagcaucacccuggaccccagcaccgugacccccaccacccccgccagcggccuggagggcagcggcgagguguacaccagcccccccaucaccaccggcagccugccccugagcgagaccacccccgagcugcccgugaccaccggcaccgacacccugagcgccggcgacguggaccccagcacccagaccgccggcggcaccagcgcccccaccgugagaaccagccugcccaacagccccagcacccccagcaccccccaggacacccaccaccccgugagaaaccugcugagcgugaccagccccggccccgacgagaccagcacccccagcggcaccggcaaggagagcagcgccaccagcagcccccaccccgugagcaacagaccccccaccccccccgccaccgcccagggccccaccgagaacgacagccacaacgccaccgagcaccccgagagccugacccagagcgccacccccggccugaugaccagccccacccagaucgugcacccccagagcgccacccccaucaccgugcaggacacccaccccagccccaccaacagaagcaagagaaaccugaagauggagaucauccugacccugagccagggccugaagaaguacuacggcaagauccugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccccgccggccugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacagccuggacaucgacggcgccgugagacugccccacaucuaccacgagggcguguucauccccggcaccuacaagaucgugaucgacaagaagaacaagcugaacgacagaugcacccuguucaccgacugcgugaucaagggcagagaggugagaaagggccagagcgugcugagacaguacaagaccgagaucagaaucggcaaggccagcaccggcuucagaagacugcugagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17033 - RNA, 5437 nt, Artificial Sequence
  mRNA product Design2 comprising derived and/or modified sequence from CCHFV(IbAr10200)__AF467768.2__GP (opt4)
ggggcgcugccuacggagguggcagccaucuccuucucggcaucaagcuuaccaugcacaucagccugauguacgccauccugugccugcagcugugcggccugggcgagacccacggcagccacaacgagaccagacacaacaagaccgacaccaugaccacccccggcgacaaccccagcagcgagccccccgugagcaccgcccugagcaucacccuggaccccagcaccgugacccccaccacccccgccagcggccuggagggcagcggcgagguguacaccagcccccccaucaccaccggcagccugccccugagcgagaccacccccgagcugcccgugaccaccggcaccgacacccugagcgccggcgacguggaccccagcacccagaccgccggcggcaccagcgcccccaccgugagaaccagccugcccaacagccccagcacccccagcaccccccaggacacccaccaccccgugagaaaccugcugagcgugaccagccccggccccgacgagaccagcacccccagcggcaccggcaaggagagcagcgccaccagcagcccccaccccgugagcaacagaccccccaccccccccgccaccgcccagggccccaccgagaacgacagccacaacgccaccgagcaccccgagagccugacccagagcgccacccccggccugaugaccagccccacccagaucgugcacccccagagcgccacccccaucaccgugcaggacacccaccccagccccaccaacagaagcaagagaaaccugaagauggagaucauccugacccugagccagggccugaagaaguacuacggcaagauccugagacugcugcagcugacccuggaggaggacaccgagggccugcuggaguggugcaagagaaaccugggccuggacugcgacgacaccuucuuccagaagagaaucgaggaguucuucaucaccggcgagggccacuucaacgaggugcugcaguucagaacccccggcacccugagcaccaccgagagcacccccgccggccugcccaccgccgagcccuucaagagcuacuucgccaagggcuuccugagcaucgacagcggcuacuacagcgccaagugcuacagcggcaccagcaacagcggccugcagcugaucaacaucaccagacacagcaccagaaucguggacacccccggccccaagaucaccaaccugaagaccaucaacugcaucaaccugaaggccagcaucuucaaggagcacagagagguggagaucaacgugcugcugccccagguggccgugaaccugagcaacugccacguggugaucaagagccacgugugcgacuacagccuggacaucgacggcgccgugagacugccccacaucuaccacgagggcguguucauccccggcaccuacaagaucgugaucgacaagaagaacaagcugaacgacagaugcacccuguucaccgacugcgugaucaagggcagagaggugagaaagggccagagcgugcugagacaguacaagaccgagaucagaaucggcaaggccagcaccggcagcagaagacugcugagcgaggagcccagcgacgacugcaucagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcaagagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaagggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacaggugggcgaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcggcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacagaagaaucgccgagcuguucagcaccaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17034 - RNA, 5449 nt, Artificial Sequence
  mRNA product Design2 comprising derived and/or modified sequence from CCHFV(Turkey-Kelkit06)__GQ337054.1__GP (opt4)
ggggcgcugccuacggagguggcagccaucuccuucucggcaucaagcuuaccaugcccaccaacaucaugcacaccccccuggugugcuucauccuguaccugcagcugcugugccugggcggcgcccacggccagcugaacgccaccgagcacaacggcaccaacaacaccaccgcccccggcgccagccagagccccaagccccccaugagcaccacccccccccacgcccccgagagcagcaccaucaagcccaccacccccaucagcgaggccgagggcagcggcgagaccaccagcccccccaacaccacccagggccugagcagccccgagaccaccagcgagagacccgccaccaccagcaucagcaccagcagcaccgacagcaccaaccccaccacccagaugaccgacaacacccccacccccaccgugagcaccagccccagcagcagccccagcacccccagcaccccccagggcauccaccaccccgccagaagccugcugagcgugagcagccccaagaccgugaccacccccacccccaccagccccggcgagaugagcagcgagaccagcagccagcacagcgccaugagcagaauccccaccccccacaccgccaccagagugagcaccgagaucaccaaccacagaacccccagacagagcgagagcagcgcccagcagaccacccccagccccaugaccagccccgcccagagcauccugcugaugagcgccgcccccaccgccgugcaggacauccaccccagccccaccaacagaagcaagagaaaccuggagaccgagaucauccugacccugagccagggccugaagaaguacuacggcaagauccugaagcugcugcaccugacccuggagcaggacaccgagggccugcuggaguggugcaagggcaaccugggcagcaacugcgacgacgacuucuuccagaagagaaucgaggaguucuucaugaccggcgagugcuacuucaacgaggugcugcaguucaagacccugagcacccugagccccaccgagcccagccacgccagacugcccaccgccgagcccuucaagagcuacuucgccaagggcuuccugagcaucgacagcggcuacuucagcgccaagugcuaccccagaagcagcgccagcggccugcagcugaucaacgugacccagcaccccgccagaaucgccgagacccccggccccaagaccaccagccugaagaccaucaacugcaucaaccugagagccagcguguucaaggagcacagagagguggagaucaacgugcugcugccccagaucgccgugaaccugagcaacugccacguggugaucaacagccacgugugcgacuacagccuggacaccgacggccccgugagacugcccagaaucuaccacgagggcaccuucauccccggcaccuacaagaucgugaucgacaagaagaacaagcugaacgacagaugcacccuggugaccaacugcgugaucaagggcagagaggugagaaagggccagagcgugcugagacaguacaagaccgagaucaagaucggcaaggccagcaccggcuucagaaagcugcugagcgaggagcccggcgacgacugcaucagcagaacccagcugcugagaaccgagaccgccgagauccacgacgacaacuacggcggccccggcgacaagaucaccaucugcaacggcagcaccaucguggaccagagacugggcagcgagcugggcugcuacaccaucaacagagugaagaguuucaagcugugcaagaacagcgccaccggcaagaccugcgagguggacagcacccccgugaagugcagacagggcuucugccugaagaucacccaggagggcagaggccacgugaagcugagcagaggcagcgagguggugcuggacgccugcgacagcagcugcgaggugaugauccccaagggcaccggcgacauccugguggacugcagcggcggccagcagcacuuccugaaggacaaccugaucgaccugggcugcccccacaucccccugcugggcagaauggccaucuacaucugcagaaugagcaaccaccccagaaccaccauggccuuccuguucugguucagcuucggcuacgugaucaccuguaucuucugcaaggcccuguucuacagccugaucaucaucggcacccugggcaagaagaucaagcaguacagagagcugaagccccagaccugcaccaucugcgagaccgcccccgugaacgccaucgacgccgagaugcacgaccugaacugcagcuacaacaucugccccuacugcgccagcagacugaccagcgacggccuggccagacacgugacccagugccccaagagaaaggagaagguggaggagaccgagcuguaccugaaccuggagagaauccccuggaucgugagaaagcugcugcaggucagcgagagcaccggcguggcccugaagagaagcagcuggcugaucgugcugcuggugcugcugaccgugagccugagccccgugcagagcgcccccgugggccacggcaagaccaucgagaucuaccagaccagagagggcuucgccagcaucugccuguucaugcugggcagcauccuguucaucgugagcugccuggugaagggccugguggacagcgugagcgagagcuucuuccccggccugagcgugugcaagaccugcagcaucggcagcgugaacggcuucgagaucgagagccacaagugcuacugcagccuguucugcugccccuacugcagacacugcagcgccgacagagagauccaccagcugcaccugagcaucugcaagaagagaaagaccggcagcaacgugaugcuggccgugugcaagagaaugugcuucagagccaccaucgaggccagcagaagggcccugcugaucagaagcaucaucaacaccaccuucgugaucugcauccugacccugaccaucugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaucgugaagggcaugaagaaccugcugaacagcaccagccuggagaccagccugagcaucgaggcccccuggggcgccaucaacgugcagagcaccuucaagcccaccgugagcaccgccaacaucgcccugagcuggagcagcguggugcacagaggcaacaagauccuggugaccggcagaagcgagagcaucaugaagcuggaggagagaaccggcgugagcugggaccugggcguggaggacgccagcgagagcaagcugcugaccgugagcaucauggaccugagccagauguacagccccguguucgaguaccugagcggcgacagacagguggaggaguggcccaaggccaccuguaccggcgacugccccgagagaugcggcugcaccagcagcaccugucugcacaaggaguggagccacagcagaaacuggagaugcaaccccaccuggugcuggggcgugggcaccggcugcaccuguugcggcguggacgugaaggaccuguucaccgaccacauguucgugaaguggaagguggaguacaucaagaccgaggccaucgugugcguggcccugaccagccaggagagacagugcagccugaucgaggccggcaccagauucaaccugggccccgugaccaucacccugagcgagcccagaaacauccagcagaagcugccccccgagaucaucacccugcaccccaagaucgaggagggcuucuucgaccugaugcacgugcagaaggugcugagcgccagcaccgugugcaagcugcagagcugcacccacggcauccccggcgaccugcaggucuaccacaucggcaaccugcugaagggcgacagagugaacggccaccugauccacaagaucgagagccacuucaacaccagcuggaugagcugggacggcugcgaccuggacuacuacugcaacaugggcgacuggcccagcugcaccuacaccggcgugacccagcacaaccacgccgccuucgugaaccugcugaacaucgagaccgacuacaccaagaccuuccacuuccacagcaagagagugaccgcccacggcgacaccccccagcuggaccugaaggccagacccaccuacggcgccggcggcaucaccgugcugguggagguggccgacauggagcugcacaccaagaagguggagaucagcggccugaaguucgccagccuggccugcaccggcugcuacgccugcagcagcggcaucagcugcaaggugagaauccacguggacgagcccgacgagcugaccgugcacgugaagaguagcgaccccgacgugguggccgccagcaccagccugauggccagaaagcuggaguucggcaccgacagcaccuucaaggccuucagcgccaugcccaagaccagccugugcuucuacaucguggagagagaguacugcaagagcugcagcgaggacgacacccagaagugcguggacaccagacuggagcagccccagagcauccugaucgagcacaagggcaccaucaucggcaagcagaacgacaccuguaccgccaaggccagcugcuggcuggagagcgugaagaguuucuucuacggccugaagaacaugcugggcagcguguucggcaaccuguucaucggcauccugcuguuccuggcccccuucgugcugcuggugcuguucuucauguucggcuggaagauccuguucugcuucaagugcugcagaagaaccagaggccuguucaaguacagacaccugaaggacgacgaggagaccggcuacagaagaaucaucgagagacugaacagcaagaagggcaagaacagacugcuggacggcgacagacuggccgacagaaagaucgccgagcuguucagcaccaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17035 - RNA, 3961 nt, Artificial Sequence
  mRNA product Design2 comprising derived and/or modified sequence from CCHVF(10200)__U39455.2__SP-GP_Gn-NSm-Gc (opt4)
ggggcgcugccuacggagguggcagccaucuccuucucggcaucaagcuuaccaugcacaucagccugauguacgccauccugugccugcagcugugcggccugggcgagacccacggcagccacaacgagaccagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17036 - RNA, 3934 nt, Artificial Sequence
  mRNA product Design2 comprising derived and/or modified sequence from CCHVF(10200)__U39455.2__IgE-leader_Gn-NSm-Gc (opt4)
ggggcgcugccuacggagguggcagccaucuccuucucggcaucaagcuuaccauggacuggaccuggauccuguuccugguggccgccgccaccagagugcacagcagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggccagggcaagaccaucgaggccuacagagccagagagggcuacaccagcaucugccuguucgugcugggcagcauccuguucaucgugagcugccugaugaagggccugguggacagcgugggcaacagcuucuuccccggccugagcaucugcaagaccugcagcaucagcagcaucaacggcuucgagaucgagagccacaagugcuacugcagccuguucugcugccccuacugcagacacugcagcaccgacaaggagauccacaagcugcaccugagcaucugcaagaagagaaagaccggcagcaacgugaugcuggccgugugcaagcugaugugcuucagagccaccauggaggugagcaacagagcccuguucaucagaagcaucaucaacaccaccuucgugcugugcauccugauccuggccgugugcguggugagcaccagcgccguggagauggagaaccugcccgccggcaccugggagagagaggaggaccugaccaacuucugccaccaggagugccaggugaccgagaccgagugccugugccccuacgaggcccuggugcugagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17037 - RNA, 3355 nt, Artificial Sequence
  mRNA product Design2 comprising derived and/or modified sequence from CCHVF(10200)__U39455.2__IgE-leader_Gn-4aa-Gc (opt4)
ggggcgcugccuacggagguggcagccaucuccuucucggcaucaagcuuaccauggacuggaccuggauccuguuccugguggccgccgccaccagagugcacagcagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggcagaaagccccuguuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17038 - RNA, 1411 nt, Artificial Sequence
  mRNA product Design2 comprising derived and/or modified sequence from CCHVF(10200)__U39455.2__IgE-leader_Gn (opt4)
ggggcgcugccuacggagguggcagccaucuccuucucggcaucaagcuuaccauggacuggaccuggauccuguuccugguggccgccgccaccagagugcacagcagcgaggagcccagcgacgacugcgugagcagaacccagcugcugagaaccgagaccgccgagauccacggcgacaacuacggcggccccggcgacaagaucaccaucugcaacggcagcaccaucguggaccagagacugggcagcgagcugggcugcuacaccaucaacagagugaggagcuucaagcugugcgagaacagcgccaccggcaagaacugcgagaucgacagcgugcccgugaagugcagacagggcuacugccugagaaucacccaggagggcagaggccacgugaagcugagcagaggcagcgagguggugcuggacgccugcgacaccagcugcgagaucaugauccccaagggcaccggcgacauccugguggacugcagcggcggccagcagcacuuccugaaggacaaccugaucgaccugggcugccccaagaucccccugcugggcaagauggccaucuacaucugcagaaugagcaaccaccccaagaccaccauggccuuccuguucugguucagcuucggcuacgugaucaccuguauccugugcaaggccaucuucuaccugcugaucaucgugggcacccugggcagaagacugaagcaguacagagagcugaagccccagaccugcaccaucugcgagaccacccccgugaacgccaucgacgccgagaugcacgaccugaacugcagcuacaacaucugccccuacugcgccagcagacugaccagcgacggccuggccagacacgugauccagugccccaagagaaaggagaagguggaggagaccgagcuguaccugaaccuggagagaauccccuggguggugagaaagcugcugcaggucagcgagagcaccggcguggcccugaagagaagcagcuggcugaucgugcugcuggugcuguucaccgugagccugagccccgugcagagcgcccccaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17039 - RNA, 2371 nt, Artificial Sequence
  mRNA product Design2 comprising derived and/or modified sequence from CCHVF(10200)__U39455.2__IgE-leader_Gc (opt4)
ggggcgcugccuacggagguggcagccaucuccuucucggcaucaagcuuaccauggacuggaccuggauccuguuccugguggccgccgccaccagagugcacagcuuccuggacagcaccgccaagggcaugaagaaccugcugaacagcaccagccuggagaccagccugagcaucgaggcccccuggggcgccaucaacgugcagagcaccuacaagcccaccgugagcaccgccaacaucgcccugagcuggagcagcguggagcacagaggcaacaagauccuggugagcggcagaagcgagagcaucaugaagcuggaggagagaaccggcaucagcugggaccugggcguggaggacgccagcgagagcaagcugcugaccgugagcgugauggaccugagccagauguacagccccguguucgaguaccugagcggcgacagacagguggaggaguggcccaaggccaccuguaccggcgacugccccgagagaugcggcugcaccagcagcaccugucugcacaaggaguggccccacagcagaaacuggagaugcaaccccaccuggugcuggggcgugggcaccggcugcaccuguugcggccuggacgugaaggaccuguucaccgacuacauguucgugaaguggaagguggaguacaucaagaccgaggccaucgugugcguggagcugaccagccaggagagacagugcagccugaucgaggccggcaccagauucaaccugggccccgugaccaucacccugagcgagcccagaaacauccagcagaagcugccccccgagaucaucacccugcaccccagaaucgaggagggcuucuucgaccugaugcacgugcagaaggugcugagcgccagcaccgugugcaagcugcagagcugcacccacggcgugcccggcgaccugcaggucuaccacaucggcaaccugcugaagggcgacaaggugaacggccaccugauccacaagaucgagccccacuucaacaccagcuggaugagcugggacggcugcgaccuggacuacuacugcaacaugggcgacuggcccagcugcaccuacaccggcgugacccagcacaaccacgccagcuucgugaaccugcugaacaucgagaccgacuacaccaagaacuuccacuuccacagcaagagagugaccgcccacggcgacaccccccagcuggaccugaaggccagacccaccuacggcgccggcgagaucaccgugcugguggagguggccgacauggagcugcacaccaagaagaucgagaucagcggccugaaguucgccagccuggccugcaccggcugcuacgccugcagcagcagcaucagcugcaaggugagaauccacguggacgagcccgacgagcugaccgugcacgugaagagugacgaccccgacgugguggccgccagcagcagccugauggccagaaagcuggaguucggcaccgacagcaccuucaaggccuucagcgccaugcccaagaccagccugugcuucuacaucguggagagagagcacugcaagagcugcagcgaggaggacaccaagaagugcgugaacaccaagcuggagcagccccagagcauccugaucgagcacaagggcaccaucaucggcaagcagaacagcaccuguaccgccaaggccagcugcuggcuggagagcgugaagaguuucuucuacggccugaagaacaugcugagcggcaucuucggcaacguguucaugggcaucuuccuguuccuggcccccuucauccugcugauccuguucuucauguucggcuggagaauccuguucugcuucaagugcugcagaagaaccagaggccuguucaaguacagacaccugaaggacgacgaggagaccggcuacagaagaaucaucgagaagcugaacaacaagaagggcaagaacaagcugcuggacggcgagagacuggccgacggcagaaucgccgagcuguucagcaccaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17040 - RNA, 1831 nt, Artificial Sequence
  mRNA product Design2 comprising derived and/or modified sequence from CCHFV(10200)__NC_005302.1/U88410.1__N (opt3)
ggggcgcugccuacggagguggcagccaucuccuucucggcaucaagcuuaccauggagaacaagaucgaagugaauaacaaagacgagaugaauagaugguucgaagaguuuaagaaaggcaacgggcuggucgauaccuucacaaauagcuacuccuuuugcgaaucuguucccaaccucgacagguucguguuucagauggccucagcuacugaugacgcacaaaaggauaguauuuaugccagcgcgcuuguagaggcuacgaaauucugugccccuauauacgagugcgcauggguguccucuaccggaaucgucaagaagggucuggaaugguuugagaaaaaugccggcacaauuaagucgugggacgaaucauauacugaguugaaaguggauguuccaaagaucgagcaguuaaccggguaccagcaggcugcacugaaauggcggaaggacauuggauuccgcgugaacgccaauacagcugcccuaagcaacaagguccucgcggaauauaaagugccgggcgagaucguaaugaguguuaaggaaaugcuguccgauaugauacgacguagaaaucuuauccugaacagggguggggacgagaauccccggggaccugugucucacgaacaugucgauuggugucgcgaguuugugaaaggcaaguacauuauggcauucaacccacccuggggcgacaucaauaaaagcgggagauccggaauugccuugguggcuaccggucucgccaagcuggcagagacugaaggcaaagggaucuuugaugaggcuaagaagacagucgaagcccugaacggauaucucgacaaacacaaggacgagguugauagggcgucagccgacaguaugauaaccaacuuacugaaacauauugcaaaggcucaagaacuuuacaaaaauagcucugccuugcgggcucaguccgcccagaucgauacggcauucucaagcuacuauuggcuguacaaggccggcgugacuccugagaccuuuccaacaguaagucaguuccuauucgagcucgguaagcaaccccgcgggacuaaaaagaugaaaaaggcucugcuuucuaccccuaugaaauggggaaagaagcuguaugaauuguuugcggacgauuccuuccagcagaaccgaauuuacaugcacccagcagugcucacagccggcagaaucagcgagaugggcgucugcuuugggaccaucccgguggcuaaucccgacgaugccgcacagggaucgggucauacgaaaucuauucugaacuuaaggacuaauacagaaaccaacaauccuugugccaagacuauaguuaaacuguucgaggugcaaaagacaggcuuuaacauccaggacauggauauugucgcuuccgaacaccuccuucaccagucacugguggggaaacaaaguccauuccagaaugccuauaacguaaagggaaaugcaaccagcgcgaacaucauaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17041 - RNA, 1831 nt, Artificial Sequence
  mRNA product Design2 comprising derived and/or modified sequence from CCHFV(Turkey-Kelkit06)__GQ337053.1__N (opt3)
ggggcgcugccuacggagguggcagccaucuccuucucggcaucaagcuuaccauggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccucagcuacugaugacgcacaaaaggauaguauuuaugccagcgcgcuuguggaggcuacgaaguucugugccccuauauacgagugcgcauggguauccucuaccggaaucgugaaaaagggucuggaaugguuugagaaagacucgggcacaauuaagucaugggaugaaaauuaugccgaguugaaagucgacgugccaaagaucgagcaguuagcuaacuaccagcaggcagcccugaaguggagaaaagauauuggguucaggguuaaugcuaacacugccgcgcuaagcaauaaggugcucgcagaauauaaagucccgggagagaucgugaugaguguaaaggaaaugcuguccgacaugauacggcgccgaaaccuuauccugaaucguggcggugaugagaaccccagagggccuguuucuagggaacacguggaguggugucgggaguuugucaaaggaaaguacauuauggccuucaauccacccuggggcgacaucaacaaaagcggccgcuccgggauugcuuugguggccaccggacucgcaaagcuggcugaaacagaggguaagggcguguuugaugaagccaaaaagaccgucgaggcgcugaacggguaucucgacaaacauagagacgaaguugauaaggccucagcagacaguaugaucacuaauuuaccuaaacacauagcuaaggcccaagagcuguacaagaacagcucugcucuuagggcccagggagcacagauugauacaccauucuccucauuuuacugguuguauaaagccggcgugacccccgagacguucccuacuaucagccaguuccuguuugaacuaggugagcaaccacgggggaccaagaaaaugaagaaagcucuccugaguacaccgaugaaguggggaaagaaacuuuacgaacuguucgcggacgauucuuuucagcagaaucgcauuuauaugcaucccgcaguauugacugccggccgaaucuccgagaugggcgugugcuucgggaccaucccugucgcuaacccagacgaugccgcacagggaagcggucacacaaagucgauucucaaucugagaaccucuacggaaacuaacaaucccugugccaaaacaauagugaaguuauuugagauccaagagaccggcuucaacauucaggacauggauaucguugcuuccgaacaucugcuccaccagucaauaguggggaaacaaaguccuuuucagaaugccuacaacgucaagggaaaugcaacuagcgcgaacauuaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17042 - RNA, 5437 nt, Artificial Sequence
  mRNA product Design2 comprising derived and/or modified sequence from CCHFV(10200)__U39455.2__GP (opt3)
ggggcgcugccuacggagguggcagccaucuccuucucggcaucaagcuuaccaugcacaucagccugauguacgccauucucugccuucagcuguguggcuugggggagacccauggaucccacaacgaaacaagacauaauaagacugacacgaugaccacacacggugauaaccccucuucagagccuccagugaguacugcuuuaagcauaacccuggacccguccacagucacccccacuacuccugcaucuggccuagaagggucgggagagguuuauaccucaccacccaucacgacuggcagccucccucugagugaaaccacaccagagcuucccgugacuaccgguacagauacccuguccgccggggacguagauccuucuacgcagacugcgggaggcacaagcgcuccaaccgugaggacuuccuugcccaauucacccaguacaccuagcaccccacaggacacgcaucaccccguccggaaccuccugucugugaccuccccuggcccagaugagacaucaacucccagcgggaccggaaaagaaaguucugccacauccagcccgcacccuguuucgaaucgcccgccaacuccucccgcaaccgcccaggguccaacagagaacgacucucauaaugcuaccgaacaccccgagucccugacucagucagcaacgccuggccucaugacaaguccaacccaaauugugcauccgcagagcgccacucccaucaccguccaggauacacacccuuccccaaccaaccgaucuaagcguaauuuaaaaauggagauuauccugacucuuagccagggguugaagaaauacuauggaaagauacugagacuacuccaacugacacuugaagaggacacggaaggccuguuggaguggugcaagaggaaccucggucuggauugugacgauaccuucuuucagaaacggaucgaagaguucuuuauuacuggggagggacacuucaaugaaguguuacaguuucgcacacccggcacccugucaacaacugagaguaccccugcuggccucccaacggccgaacccuucaaguccuacuuugcgaaaggguuccuuagcaucgacucuggauauuacucagcaaagugcuauagugguaccagcaacuccggccugcaguugauuaauaucacaagacauucuacuaggauaguagacaccccggggccuaaaauuacaaaccuaaagacuaucaauuguauuaaccugaaggccucgaucuuuaaagagcaccgggaaguugagaucaacgugcuccugccacaagucgcugugaaucuuagcaacugccauguggucauuaagucccacguuugugauuacucacuggacauagauggagccgugcgcuugccccauaucuaccacgagggcguauucauuccugguaccuauaaaaucgugauagacaagaaaaauaagcucaacgaucgaugcacgcuguuuacagacugugucauuaaagggagagaagugaggaagggccagaguguuuuacggcaguacaagaccgagauccguaucggaaaagcaucuacuggcuuccgcagacugcuaagcgaggaacccuccgaugacugcgugucaaggacacaacuccugcggaccgaaacugcugagauucacggggauaauuauggagguccaggcgacaagaucaccauuuguaacgggagcacaauagucgaucagcgacuuggaucugaguugggcugcuacacgaucaaucgcgugagauccuuuaaacugugcgaaaacagugccaccgguaagaauugugagauugacagcguaccuguuaaaugcaggcagggguauugucuccggaucacucaggaaggccgcggacaugugaagcugucuagaggcuccgaggucgugcuugacgcgugcgauacaucaugugagaucaugauucccaaggggaccggagacauacuggucgauugcagugguggccaacagcacuucuugaaagacaaccucaucgaucugggguguccaaagauuccguuacugggaaaaauggccaucuacauuugcaggaugagcaaucauccuaagacaacuauggcauuccuauuuugguucucguuuggcuaugugaucaccuguauacucugcaaagcuaucuucuaccugcuuauuaucguugguacguuggggcgucggcugaagcaguaccgagaacucaagccccagacauguaccauuugcgagacuaccccagugaacgccaucgacgcugaaaugcacgaucugaauugcuccuauaacauaugucccuacugcgccucuagauuaacaagcgacggccuggcaaggcacguaauucaauguccuaaacgcaaggagaaagucgaagagacugagcuuuauuugaaucucgaacggaucccaugggugguuagaaagcugcuacaggugucagagaguaccggagucgcccugaaaagguccucuuggcucauugugcugcuuguauuguuuacagugagccugucccccguucagucagcuccuaucggccaggggaagacgauagaagcguaccgcgcacgagagggauauaccagcaucugcuuauucguccucggcaguauucuguuuaucgugucuugucuuaugaagggucugguggauuccgucgggaacagcuucuuuccgggauugucgauuugcaaaacuuguucaaucucuaguauaaacggcuucgaaauugagucccauaagugcuacuguagccucuuuugcuguccauauugccggcacugcucuacagacaaagagauccauaagcugcaccuaagcaucuguaaaaagcguaaaaccgguuccaauguuaugcuggccgugugcaagcucauguguuucagagcuacuauggaagugucaaacagggcccuguuuauucgcaguaucauuaauacaaccuucguacuuugcauauugauccuggcagucugugugguuagcacgucugccguggagauggaaaacuuacccgcuggcacuugggagcgggaagaggaucucaccaauuucugccaucaagagugucaggucacagaaaccgagugccuguguccuuacgaagcccuugugcugagaaagccacuauuucucgacuccacugcaaaagggaugaagaaccugcucaauucaacaagucuggagaccagcuuauccauugaggcgcccuggggagcuaucaacguucagucuacauacaaaccuacugugucgaccgccaauauugcacucagcuggucauccguagaacacaggggcaacaagauccuggucagugggcgaucugagagcauaaugaaacuugaggaacgcacgggaaucuccugggaucugggcguggaagacgccucagagucuaaguugcucacagugagcgucauggaccugagucagauguauuccccgguuuucgaguaccuaagcggugaucggcaaguggaagaguggcccaaggcuaccugcacuggggacuguccagaaagaugcggaugcaccucuucaacaugucugcacaaagaguggccucauuccaggaauuggcguugcaaccccacuugguguuggggcguagguaccggcugcacguguugcgggcuugaugugaaggaccucuuuacagauuauauguucgucaaauggaagguggaauacauuaaaaccgaggccaucguuuguguggagcugacaagucaggaacgccagugcagcuugauugaggcaggaacacgguuuaaucugggcccagucaccaucacuuuaucggaaccuagaaacauacaacagaaguugcccccagagauuaucacacugcacccgaggaucgaagagggguucuuugaccuuaugcaugugcagaagguucugucugcuuccaccguguguaaauugcagagcugcacgcacggagucccuggcgaucuccaaguauaucauauugguaaucugcuaaagggggacaaagugaacggacaccugauacacaagaucgagccccauuucaacacuucauggaugaguugggauggcugugaccuugauuacuauugcaauaugggugacuggccaucuugcaccuacacaggcguuacccagcacaaccaugccuccuuugugaaucuccugaacauugaaacagauuacacuaaaaauuuccacuuucacagcaagcgagucaccgcgcauggggacacgccccaguuggacuuaaaggcccggccuacauauggagcuggcgagaucacugugcugguagaaguggcagauauggagcuccacaccaaaaagauugagaucucagggcugaaauucgccagucuugcuuguacaggaugcuacgccuguagcuccucuauaagcugcaagguccgcauccauguugacgaaccagaugagcugaccgugcacgugaaauccgacgaucccgacgucguggcagcgucaucuaguuugauggccagaaagcuagaauuuggcacugauucgaccuucaaggcuuucagcgccaugccuaaaacaucccuguguuuuuauauuguugagagggaacauugcaagucuuguucagaggaggacacgaaaaagugcguaaacacuaaacucgaacagccgcaaagcauccugauugagcacaaggguaccaucauagggaaacaaaauuccacauguaccgcaaaggcuaguugcuggcuugaaucugucaagagcuucuuuuacggacugaaaaacauguuaucaggcauuuucggcaauguguuuauggggaucuuccucuuuuuggccccauucauccugcucauucuguuuuucauguuuggauggcggauccuuuucuguuucaagugcugccgaagaacucgcggucuguuuaaauauaggcacuugaaggaugacgaggaaacaggcuaccgucggauaauugagaaacuaaacaauaagaaggggaaaaacaagcugcucgauggagagagauuagcagacggcaggaucgccgaacuguucuccaccaaaacgcauauugguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17043 - RNA, 5437 nt, Artificial Sequence
  mRNA product Design2 comprising derived and/or modified sequence from CCHFV(IbAr10200)__AF467768.2__GP (opt3)
ggggcgcugccuacggagguggcagccaucuccuucucggcaucaagcuuaccaugcacaucagccugauguacgccauucucugccuucagcuguguggcuugggggagacccauggaucccacaacgaaacaagacauaauaagacugacacgaugaccacacccggugauaacccuucuucagagccaccggugaguacugcuuuaagcauaacccuggaccccuccacagucaccccuacuacaccagcaucuggccuagaagggucgggagagguuuauaccucacccccuaucacgacuggcagccucccacugagugaaaccacacccgagcuuccugugacuaccgguacagauacccuguccgccggggacguagauccaucuacgcagacugcgggaggcacaagcgcuccgaccgugaggacuuccuugcccaauucaccuaguacaccaagcacaccccaggacacgcaccauccuguccggaaccuccugucugugaccuccccaggccccgaugagacaucaacuccgagcgggaccggaaaagaaaguucugccacauccagcccucaccccguuucgaaucgcccaccuacucccccagcaaccgcccagggucccacagagaacgacucucacaaugcuaccgaacauccugagucccugacucagucagcaacgccaggccucaugacaaguccgacccaaauugugcacccccagagcgccacuccuaucaccguccaggauacacauccaucccccaccaaccgaucuaagcguaauuuaaaaauggagauuauccugacucuuagccagggguugaagaaauacuauggaaagauacugagacuacuccaacugacacuugaagaggacacggaaggccuguuggaguggugcaagaggaaccucggucuggauugugacgauaccuucuuucagaaacggaucgaagaguucuuuauuacuggggagggacacuucaaugaaguguuacaguuucgcacaccuggcacccugucaacaacugagaguaccccagcuggccuccccacggccgaaccguucaaguccuacuuugcgaaaggguuccuuagcaucgacucuggauauuacucagcaaagugcuauagugguaccagcaacuccggccugcaguugauuaauaucacaagacacucuacuaggauaguagacaccccugggccaaaaauuacaaaccuaaagacuaucaauuguauuaaccugaaggccucgaucuuuaaagagcaucgggaaguugagaucaacgugcuccugccccaagucgcugugaaucuuagcaacugccacguggucauuaagucccauguuugugauuacucacuggacauagauggagccgugcgcuugccucacaucuaccaugagggcguauucauucccgguaccuauaaaaucgugauagacaagaaaaauaagcucaacgaucgaugcacgcuguuuacagacugugucauuaaagggagagaagugaggaagggccagaguguuuuacggcaguacaagaccgagauccguaucggaaaagcaucuacuggcagccgcagacugcuauccgaggaaccaucagaugacugcauuagcaggacacaacuccugcggaccgaaacugcugagauccacggggauaauuauggagguccuggcgacaagauuaccauauguaacgggucuacaaucguggaucagcgacuuggauccgaguugggcugcuacacgauuaaucgcgucagaaguuucaaacugugcgaaaacagcgccaccgguaagaauugugagaucgacucugugcccguaaaaugcaggcagggguauugucuccggaucacucaggaaggccgcggacacguuaagcuguccagaggcucagaggugguccuugacgcgugcgauacaaguugugagauuaugauaccaaaggggaccggagacauccugguggauugcagcgguggccaacagcauuuucuuaaagacaaccucauugaucugggguguccgaagaucccuuuacugggaaaaauggccauuuacaucugcaggaugucgaaucaccccaagacaacuauggcauuccuauucugguuuuccuucggcuaugucauaaccuguauccucugcaaagcuaucuuuuaccugcuuauuauuguggguacguuggggaagcgucugaagcaguaccgggaacucaaaccacagacauguaccaucugcgagacuacccccguuaacgccauagacgcugaaaugcaugaucugaauugcucuuauaacauuuguccuuacugcgccagccgauuaacaucagacggccuggcaagacacgugauccaauguccaaagaggaaagagaagguagaagagacugagcuuuauuugaaucucgaacgcauucccugggucgugcggaaacugcuacagguuagugaguccaccggaguggcccugaagagaucuagcuggcucaucguccugcuuguguuguucacaguaucccugucaccugugcagagcgcuccgauaggccaggggaagacgaucgaagcguacagggcacgcgagggauauaccaguauuugcuuauuuguucucggcucuauccuguucauugucuccugucuuaugaaaggucugguggauagcguggggaacucguuuuucccaggauugucaaucugcaagacuuguucuauaaguuccauuaacggcuuugaaaucgagagccacaaaugcuacuguucucucuucugcugucccuauugccgacauugcagcacagacaaggagauccacaaacugcaucuauccauuuguaagaaacggaagaaggguucaaaugucaugcuggccguuugcaaacucauguguuuucgugcuaccauggaagugaguaacagagcccuguucaucaggagcauuauaaauacuacauuugugcuuugcaucuugauucuggcaguaugugucgugucuaccuccgccguugagauggaaaacuuaccugcuggcacgugggagcgcgaagaggaucucacuaauuucugccaccaagagugucaggugaccgaaacagagugccuguguccauacgaagcccuuguccugcggaagccccuauuccucgacucaaccgcaaaagggaugaagaaccuguugaauaguacuagccuggagacauccuuaucuaucgaggcgccuuggggagcuauuaacgugcagucgaccuacaaaccgacaguuagcacugccaauaucgcacucucaugguccaguguggaacauagaggcaacaagauacugguaucugggaggagcgaguccaucaugaaacuugaggaacgaaccggaauuucaugggaucugggcgucgaagacgccucugagagcaaauugcucacggugagugugauggaccugucccagauguauagccccgucuuugaguaccuaucuggugaucgccaaguuggggaauggccaaaggcuacaugcaccggagacuguccugagcggugcggcugcacuucauccaccugucugcacaaagaauggccccacaguagaaauuggaggugcaacccaacaugguguuggggugugggcacugggugcaccuguugcggacuugauguaaaggaccucuucacggauuauauguuugugaaauggaaggucgaguacaucaagacagaagccauuguguguguugagcugaccagccaggagcgucagugcucguugaucgaagcaggcacucgcuucaaucuggggccugugacaauaaccuuaucugagccccggaacauucaacagaaacucccaccggaaaucaucacucugcauccuagaauugaggaaggauuuuucgaccuuaugcacguccagaaggugcuguccgcuagcacaguuuguaaauugcagucaugcacccauggcgugcccggugaucuccaagucuaucacauagggaaucugcuaaagggagacaaaguaaacggccaucugauccacaagauugagccacacuuuaacacgaguuggaugucuugggaugguugugaccuugauuacuauugcaauaugggcgacuggcccuccugcacuuacaccggggugacacagcauaaccacgccagcuucguuaaucuccugaacaucgagaccgauuacacaaagaauuuucauuuccacucaaaaagggugacugcgcacggagacaccccucaguuggacuuaaaggcccgaccaacguauggcgcuggggaaauuacaguccugguggagguagcagauauggaacuccauacuaaaaagaucgagauaaguggacugaaauuugccagccuugcuuguaccggcugcuacgccuguuccucugguaucagcugcaaggugcggauucacgucgacgagcccgaugaacugacaguucaugugaaauccgacgauccugacguggucgcagcgucaucuaguuugauggcccgcaagcuagaguucgggaccgauucgacuuuuaaggcuuucagcgccaugccgaaaaccucccuguguuucuauaucguggaaagagagcacugcaagucuuguucagaagaggacaccaaaaagugcguuaacacgaaacucgagcagccacaaagcauucugaucgaacauaagggaacuauaauuggcaagcaaaauuccaccuguacagcaaaagcuaguugcuggcuugagucuguaaagagcuuuuucuacggcuuaaagaacaugcugucagggaucuuuggaaauguguucauggguaucuuucucuucuuggcccccuuuauucugcucauccuguucuuuauguucggcuggaggauauuguuuuguuucaagugcugccggcgaaccagagggcuguucaaauaucgccacuugaaggaugacgaagagacuggauacaggcguauuaucgaaaagcuaaacaauaaaaagggcaaaaacaagcugcucgauggugagcgguuagcagacagaaggauugccgagcuguuuuccacaaaaacccacaucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17044 - RNA, 5449 nt, Artificial Sequence
  mRNA product Design2 comprising derived and/or modified sequence from CCHFV(Turkey-Kelkit06)__GQ337054.1__GP (opt3)
ggggcgcugccuacggagguggcagccaucuccuucucggcaucaagcuuaccaugcccaccaacaucaugcacacaccucuggugugcuucauucucuaccuucagcuguuguguuuaggcggggcccauggacaacugaaugcuacugagcacaacgguacgaauaacaccacagcaccaggcgccagccaguccccgaagcccccuaugucuacuaccccaccccaugcgccugaaucaaguacaauaaaaccaaccacucccaucagcgaggcugaaggguccggagagacaaccucuccuccaaauacgacucagggccuaucgucaccggaaaccacaagcgagagacccgccacuaccaguauuuccacaucuagcaccgacuccacgaacccuacuacacagaugaccgauaauacuccaacacccaccgucucaacgaguccuucuucuuccccaucaacccccagcacaccgcaagguauccaccauccugcaaggagucuccugucuguuuccagccccaagacugugaccacaccaacuccuaccucgcccggggagaugucuuccgaaacaucaagucagcacagcgccaugucccggauuccaacuccccacacugcuacgcgcguaucuacagagaucaccaaccaucgaacuccucgucagagcgaaucaagugcacagcaaaccacaccauccccgaugaccagccccgcccagucuauacuucugaugucagcugccccuacugcggugcaggacauccacccaagucccacaaauagaagcaaaaggaacuuggagacggagauuauccucacccugucccagggacugaagaaauauuacggcaagauucucaaguuacugcaucuuacuuuggaacaagauacagagggccugcuagaauggugcaaagggaaucucggaucuaacugugacgaugacuuuuuccagaagcggaucgaggaauuuuucaugaccggugagugcuauuuuaaugagguccugcaguucaaaacacuuucgacucugagcccuaccgaaccaucccacgcacgcuugcccacggccgagccguuuaagucauacuucgcuaaaggcuuucucaguauagauucuggguauuucagcgccaaguguuacccuagauccucagcaagcggacugcaauuaauuaacgugacccagcacccagcuaggaucgccgaaacacccggcccuaagacuaccucucugaaaacaauuaauugcaucaaccuccgggcguccguuuuuaaggagcaucgcgaaguggagaucaacguccuucugccccagauugccgugaauuugaguaacugucacguaguuauaaauagccaugugugcgacuauucucuagauacugacgguccaguccgacugccuagaaucuaccacgaggggaccuucauucccggaacguacaaaaucgugauagauaagaaaaacaagcucaaugacagguguacacuggugaccaacugcgucauuaaaggccgggaaguucguaagggccaguccgugcuucgccaauauaagacugagaucaaaaucgggaaggcaucaacaggauuuagaaaacuguugagugaggaaccaggugaugacuguauuagcaggacccagcuccugcggacugaaaccgcugagauccaugacgauaauuacggcgggccgggagacaagauuacaauaugcaacggcucgacgaucguagaucagcgauuagguuccgagcuggggugcuauaccauuaaucgcgugaaaucuuucaagcuauguaagaacagcgccacuggcaaaacaugcgaagucgacucaaccccugugaaguguagacagggauucugccucaaaaucacacaagagggcagggggcacguuaagcugagucggggauccgaagugguccuugaugcuugugacucuagcugcgaggugaugauccccaaagguacuggcgauauuuugguagacuguuccgggggacagcagcacuuucugaaggauaaucucauagaccugggcugcccacauaucccccuucugggucgcauggccauuuacaucuguagaaugucaaaccacccuaggaccacgauggcauucuuguuuugguucagcuuuggguauguuauuacaugcaucuucuguaaggcccucuuuuacagucugauaaucauuggcaccuuagggaaaaagaucaaacaguaucgugagcugaagccacaaacuugcaccauuugcgaaacagcucccgugaaugcgaucgaugcagagaugcaugaccuaaacuguucuuacaauauaugcccuuacugugccucccggcucacuagcgacggccuggcucgacacgucacccagugcccgaaaagaaaggaaaagguggaggaaacagagcuuuauuugaaccuggagaggauuccauggaucguccgcaaacuccugcaagugucggaaucaacggggguugccuuaaagcggucuaguuggcugauugugcuuuugguacuccugaccgucucccuaagccccgugcagucugcaccuguuggacacgguaaaacuaucgagauauaccagacaagagaaggcuucgccagcaucugucuguuuaugcucggguccauucuguucaucgugucaugccuugucaagggauugguggauaguguaagcgagagcuuuuucccaggccuguccguguguaaaaccugcucaauugguaguguuaacggguuugaaaucgagagccauaaguguuauugcuccuuauucuguugccccuacugcaggcacuguucugcugaccgcgagauacaucagcuccaccugucgauuugcaaaaagcgaaagacuggcagcaaugucaugcuugccguguguaaacggaugugcuuccgugcaacaaucgaagcgucaagaagggcucuguugauccgcuccauuaucaacaccacguuugugauuuguauacucacucugaccaucugcgucguuaguacaucugccguggagauggaaaaucuaccugcaggaaccugggagcgggaagaggaucugacuaacuucugucaucaggagugccaagugacagaaaccgagugucucugcccguaugaagcccugguacuuagaaagcccuuguuucuggacagcauugucaaaggcaugaagaauuuacucaacuccacaucacuggagacuucucuuagcaucgaggcuccauggggagccauuaaugugcagaguaccuucaaaccuacgguuuccacagcaaacaucgcucugagcuggucuucagugguccacaggggaaauaagauauuggugaccggccgauccgaaaguaucaugaagcucgaggaacgcacugguguuagcugggaucuggggguggaggacgccucggaaucuaaauugcugaccguauccauuauggauuuaagccagauguacucacccgucuuugaguaucucaguggagacagacagguggaggaauggccaaaggcgacauguacuggcgauugcccugagcggugcgguuguaccucuuccacgugccugcacaaagaauggagccauucaaggaacuggcguuguaaucccacauggugcuggggcguggggaccggauguacuugcuguggcgucgacguuaaggaucuuuucacagaccacauguuugugaaauggaagguagaguacaucaagaccgaagccauugugugcgucgcucugaccagucaagagcgccaguguagcuugaucgaggcagggacacgguucaaccucggaccagugaccauaacgcuguccgaaccgagaaauauucagcagaaacuaccucccgagaucaucacucugcauccaaagauugaagagggcuuuuucgaucuuaugcacguucaaaaagugcucucugccagcaccgucugcaagcugcaguccuguacacaugguauacccggggaccuacagguguaccacaucggaaaccuguuaaaaggcgacaggguuaauggucaccucauucauaagaucgaaucacacuuuaacaccucuuggaugaguugggauggcugcgaccuggauuauuacugcaacaugggggacuggccuucguguacauauacuggagugacccagcauaaucacgcugccuucgucaaccuucugaauauugagacggauuacacaaagacuuuucacuuccauagcaaacgaguaaccgcacacggcgacacaccacaauuggaucucaaggcgcggcccaccuauggggccggaggcaucacugugcugguugagguggcugacauggaacuacauaccaaaaaggucgagauauccggucugaaauucgccucucuugcaugcacaggguguuacgcuugcucaagcggaaucuccuguaaggugcgcauucacguagaugaaccugacgagcucacggugcaugucaaaaguucugauccggacguuguggccgcaagcacuucacugauggccagaaaguuggaguuuggcaccgauuccacauucaaggcuuuuagugcgaugccaaaaaccagcuuaugcuucuauaucguggaaagggaguacuguaagucuugcuccgaagacgacacucagaaaugugucgauacacggcuggagcagccccaaucaauucucaucgaacacaaggguaccauaauuggcaaacagaacgacacgugcacugccaaggcaagcuguuggcuggagucggugaagucuuucuuuuacgggcuuaaaaauaugcugggaaguguuuuuggcaacuuguucaucgggauccuacuguuucucgcuccuuucguacugcuuguguuauuuuucauguucggauggaagauucuguuuugcuucaaaugcugucgaagaacacgcggccucuuuaaguauaggcacuugaaagaugacgaggaaaccgguuaccgucggaucauagagagacugaacuccaagaaggggaaaaauaggcuccuggauggagaccgccuugccgaucgaaagauugccgaacuguucagcaccaaaacucauaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17045 - RNA, 3961 nt, Artificial Sequence
  mRNA product Design2 comprising derived and/or modified sequence from CCHVF(10200)__U39455.2__SP-GP_Gn-NSm-Gc (opt3)
ggggcgcugccuacggagguggcagccaucuccuucucggcaucaagcuuaccaugcacaucagccugauguacgccauucucugccuucagcuguguggcuugggggagacccauggaucccacaacgaaacaucugaggaacccucagacgauugcgugaguagaacucaauuacugaggacggagaccgcugaaauacauggugacaauuauggcgggccuggagauaagaucacaauuuguaacggcagcacuaucgucgaccagcggcuagguuccgagcucgggugcuacaccauuaaucgcguucgaucuuucaaacugugugagaacucggcaacaggaaagaauugcgaaaucgauucagugccaguaaaaugucgucagggcuauugccuuagaauaacccaggagggcagggggcacgugaagcugagccggggaagugaagucguguuggacgccugugauacuuccugcgagaucaugauuccgaaagguacaggcgacauccucguugauuguucugggggacaacagcauuuucugaaggacaaccugauugaucucggcugccccaagaucccuuuacuggguaaaauggcgauauacauuugccgcaugagcaaucacccaaagaccacgauggcuuucuuguuuugguucuccuuuggguaugugaucacuuguauucuuugcaaagccaucuucuaccugcuaaucauugucggaacccucggcagaaggcugaagcaguaucgggagcuuaaaccccagacauguacuauaugcgaaaccacaccugugaacgcaaucgacgccgagaugcacgaucugaauuguucauacaacauuugcccauacugugcuagucgcuugaccagcgacggccucgcacgacauguaauccaaugccccaagagaaaggaaaaaguugaggaaacggagcuguauuuaaaucuggagaggauaccuugggugguccggaagcuccuucaggugucugaauccacugggguggcccugaaacguucaagcugguugauuguccuacugguucucuuuacagugagucugucuccaguacaguccgcuccgaucggacaggguaagaccaucgaggccuaccgcgcgagagaaggcuauacuagcauuugucuuuucgugcuggggucgaucuuguuuauugucucuugccucaugaaaggacugguggacuccguuggcaacucauucuuucccgguuuaaguauauguaagacaugcagcaucuccucuauuaauggguucgagaucgaaagccacaaaugcuacuguucacuguuuugcuguccuuauugcaggcauuguaguaccgauaaggagauccacaagcuacaccucuccauuugcaaaaagcggaaaacgggcagcaacgugaugcuggcagucuguaaacuuaugugcuuccgagccaccauggaggugucuaaucgcgcuuuguucauaagaucaaucauuaacacaacuuuuguacuguguauccucauucuggccguuugcguggucaguaccagcgcaguggaaauggagaaccuuccagcuggaacaugggaaagggaggaagaccugacuaauuucugucaucaagagugccaggucaccgagacagaaugcuugugucccuacgaggcccucgugcugcggaaaccuuuauuucuggauuccaccgcgaagggcaugaagaaccuacucaauucuacuucgcuggaaacgagccuuuccaucgaggccccauggggagcaauaaacguucagucaacauauaaacccaccgugaguacugcuaauaucgccuugucuuggagcuccguagagcaccgcgggaacaagauucuggucucagguagaagcgaaucuaucaugaaacucgaggaaaggaccggcauuuccugggaccuggggguggaggaugcuagugaaagcaaguuacugacaguuucugugauggaccuuucccaaauguacucaccggucuucgaguacuugaguggagaucgucagguggaggaauggccuaaagcaaccugcacuggcgacugucccgagcggugcgguuguacaagcucgacgugccuccauaaggaauggccacacucccgaaauuggagauguaacccuaccuggugcuggggcguagggacuggauguacaugcuguggccuggaugugaaggaccuauuuaccgauuauauguucguuaaauggaaggucgaguacaucaaaacagaagccauagugugcguggagcugacuucucaggagaggcagugcagccucauugaagccgggacccgcuuuaaucugggacccgucacgaucacccuuucagagccacggaacauucaacagaaguugcccccugaaaucauaacacugcauccaagaaucgaggaagguuucuuugacuuaaugcacguucagaaagugcucagugcuuccacuguguguaagcugcagucuugcacccacggcguaccgggggaccuucaagucuaucauauuggaaaucuguugaagggcgauaaagugaacggucaccucauccauaagauugagccccacuucaauacaagcuggauguccugggacgggugugaucuggacuacuauugcaacaugggcgauuggccuucauguacuuacaccggaguuacgcagcacaaucaugcgagcuuugugaaccuacugaacaucgagacagacuauaccaaaaauuuccacuuucauaguaagagggucacugcacacggcgauacaccacagcucgaccugaaagcccgccccaccuacggggcuggagaaauaacugugcuuguugagguggccgauauggaauugcauaccaagaaaauugagaucucuggccugaaguucgcauccuuagccugcacagguuguuacgcuugcagcucgucaaucucuuguaagguacggauucacgucgacgagccugaugaacucacggugcacgugaaaagugacgauccagacgucguugccgcauccagcucucugauggcgcgaaaacuugaguucgggaccgacagcacuuuuaaggcuuucuccgccaugcccaagacaucacugugcuuuuauaucguggaacgugagcauuguaagaguugcagcgaagaggauaccaagaagugcguaaacacaaaacuagagcagccgcaaucuauucucauagaacacaagggaacuaucauuggcaaacagaauagcaccuguacggcaaaggccucaugcuggcuggagagugugaaauccuucuuuuacgguuugaagaacaugcuguccggcaucuucgggaaugucuuuaugggaauuuucuuauuucucgcuccuuucauccugcuuauacuguuuuucauguuuggcuggagaaucuuguucuguuucaagugcuguaggcgcacacgggggcucuuuaaauauagacaucugaaggacgaugaagagaccggauacaggcgaauuaucgaaaaacuaaacaauaagaaaggcaagaacaagcugcuugacggugagcgccucgccgaugggcggauugcagagcuguucucuacuaaaacccacaucggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17046 - RNA, 3934 nt, Artificial Sequence
  mRNA product Design2 comprising derived and/or modified sequence from CCHVF(10200)__U39455.2__IgE-leader_Gn-NSm-Gc (opt3)
ggggcgcugccuacggagguggcagccaucuccuucucggcaucaagcuuaccauggacuggaccuggauccuguuccucguggccgcugcaacaagaguccacagcuccgaggaacccucugaugacugcguuucaaggacucagcuucugcggacggagaccgccgaaauucauggcgauaacuacgggggaccuggugacaagauaacaaucuguaauggcaguacuauuguggaucaacgcuuggggagcgaguuaggaugcuauaccaucaaccgaguacguuccuuuaaacugugugaaaauucugcgacaggcaagaacugcgagauugacucggugccagucaaauguagacaggguuacugccuaaggaucacccaggaggggcggggacacgugaagcucucacgcggcagcgaaguugugcuggaugcuugugacaccaguugcgagauaaugaucccgaaaggcacaggggauauucuugucgacuguuccggaggucagcaacauuuccugaaggauaauuugaucgaccucggcugccccaagauuccucugcuggggaaaauggccaucuauauauguagaaugucuaaccacccaaagaccacgauggcauuucucuucugguuuagcuucggauacgugauuacuugcaucuuaugcaaagccaucuuuuaucugcuuauuaucguaggcaccuuggguaggcggcugaagcaguaccgcgaacuaaaaccccagacauguacuauuugcgagaccacaccuguuaaugcuauagaugcagagaugcaugaccucaacuguuccuauaauaucugcccauacugugccucacgacugaccagugacgggcuugcuagacacgugauucagugccccaagaggaaggaaaaagucgaggaaacggagcuguacuugaaccucgaacggaucccuuggguggugcguaagcuguuacaagucagcgagucuacuggaguugcccugaaacgcuccucauggcucauagugcuucugguauuguucacagugagccuaaguccaguccagucugcgccgauuggccagggcaagaccaucgaggcauauagagccagggaaggguacacuuccaucugucuguuugugcucggaagcauucuguucaucguuucgugccuuaugaaaggucugguggauucugucggcaauuccuuuuuccccggguugucaauuuguaagacaugcaguauaagcuccaucaacggauuugagauugaaucucacaaauguuauugcagccucuucugcuguccuuacugccggcauuguucaaccgacaaggagauccacaagcugcauuuaaguaucugcaaaaagcgaaaaacgggcuccaaugugaugcuggcuguauguaagcuaaugugcuuccgcgccaccauggaaguuagcaacagagcacucuuuauuaggucuauaaucaauacaacuuucgugcuguguauucuuaucuuggcugucugcguggucucaaccagugccguggagauggagaaccugccagcggguacaugggaacgggaggaagaucucacuaacuuuugucaccaggagugccaaguuaccgaaacagagugucugugccccuaugaggcccuugugcugcgcaaaccuuuguuccucgacagcaccgcaaaggggaugaagaaucuguuaaacuccacuucucuggaaacgucgcuaagcauugaggcuccauggggcgccaucaauguacaguccacauacaaacccaccgucucaacugcuaacauagcccucaguuggucuagcguggaacacagaggaaauaagauccugguuuccggcaggucagagagcauuaugaaacuugaggaacguaccgggaucucuugggauuugggaguggaggacgcauccgaaaguaagcugcucacagucagcgugauggaucugucucagauguauuccccgguauuugaguacuuaucaggugaccggcaaguggaagaguggccuaaagccacuugcacuggcgauugucccgagcgaugcggguguacaaguagcacgugccugcauaaggaauggccacacucgagaaacuggagguguaauccuaccuggugcuggggaguuggcacugguuguacaugcugugggcuugacgucaaggauuuguucaccgacuacauguuugugaaauggaagguggaguauauuaaaacagaagcuaucgucugcguugagcucacuucccaggaacgccaguguucucugauagaggcgggcacccgguucaaccuaggacccgugacgauuacccugagcgagccaagaaauauccagcaaaagcugcccccugaaauuaucacacuccauccaaggauagaggaaggcuuuuucgaccuuaugcacgugcagaaaguauugucagcaaguacugucugcaagcugcaguccugcacccauggggugccgggagauuuacagguuuaccacaucgguaaccuccugaagggcgacaaagugaaugggcaccuuauucauaagaucgagccccacuuuaacacaucuuggaugagcugggauggaugugaccuggauuauuacugcaauaugggcgacuggccuuccuguacuuauaccggugucacgcaacauaaccacgccucauucgugaauuugcucaacauugaaacagauuacaccaaaaacuuucacuuccauagcaagcgcguuacugcucacggggacacaccacagcuggaucuaaaagcccgacccaccuauggcgcaggagagaucacugugcugguagaggucgccgacauggaacuccauaccaagaaaauagagauuaguggccugaaguucgcuucucuugccugcacaggguguuacgcaugcuccagcucgaucucauguaaggugcggauccacguggaugaaccugacgaguugacgguccauguuaaaucugaugacccagacgugguagcggcuaguuccagccugauggcccguaaguuagaguuuggaaccgauucuacuuucaaagcauuuagcgccaugcccaagacaucccucugcuucuacauuguggaaagagagcacuguaaaucaugcagugaagaggacaccaagaagugugucaauacaaaacuggaacagccgcagagcauccuuauugagcacaagggcacuauaaucgguaaacaaaacucuaccugcacggcuaaggccuccugcuggcuggagucagugaaaaguuucuuuuaugggcuaaagaauaugcucagcggaauuuuuggcaacguuuucauggguaucuuucuguucuuggcaccuuuuauucuguuaauccucuucuuuauguucggcuggaggauacuguucuguuuuaagugcugucgccggacaagagggcuuuucaaauacaggcaucugaaggaugacgaagagaccggauaucgacgcaucauugaaaaauugaauaacaagaaaggcaagaauaagcuccuggauggggagcggcuagcugacggaagaaucgccgaacuguuuuccacuaaaacccacauuggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17047 - RNA, 3355 nt, Artificial Sequence
  mRNA product Design2 comprising derived and/or modified sequence from CCHVF(10200)__U39455.2__IgE-leader_Gn-4aa-Gc (opt3)
ggggcgcugccuacggagguggcagccaucuccuucucggcaucaagcuuaccauggacuggaccuggauccuguuccucguggccgcugcaacaagaguccacagcuccgaggaacccucugaugacugcguuucaaggacucagcuucugcggacggagaccgccgaaauucauggcgauaacuacgggggaccuggugacaagauaacaaucuguaauggcaguacuauuguggaucaacgcuuggggagcgaguuaggaugcuauaccaucaaccgaguacguuccuuuaaacugugugaaaauucugcgacaggcaagaacugcgagauugacucggugccagucaaauguagacaggguuacugccuaaggaucacccaggaggggcggggacacgugaagcucucacgcggcagcgaaguugugcuggaugcuugugacacaaguugcgagauaaugaucccgaaaggcacaggggauauucuugucgacuguuccggaggucagcaacauuuccugaaggauaauuugaucgaccucggcugccccaagauuccucugcuggggaaaauggccaucuauauauguagaaugucuaaccacccaaagaccacgauggcauuucucuucugguuuagcuucggauacgugauuacuugcaucuuaugcaaagccaucuuuuaucugcuuauuaucguaggcaccuuggguaggcggcugaagcaguaccgcgaacuaaaaccccagacauguacuauuugcgagaccacaccuguuaaugcuauagaugcagagaugcaugaccucaacuguuccuauaauaucugcccauacugugccucacgacugaccagugacgggcuugcuagacacgugauucagugccccaagaggaaggaaaaagucgaggaaacggagcuguacuugaaccucgaacggaucccuuggguggugcguaagcuguuacaagucagcgagucuacuggaguugcccugaaacgcuccucauggcucauagugcuucugguauuguucacagugagccuaaguccaguccagucugcgccgauuggcagaaagccccuguuucucgauuccaccgcaaaaggcaugaagaaucugcuuaacagcacuucgcuggagacaucuuuguccaucgaagccccuuggggagcuaucaaugugcagucaaccuauaaaccaacgguuaguaccgccaacauugcacucagcugguccucuguggagcacagggggaauaagauccuggucagcggucggucagaaaguauuaugaaguuagaggaacgaacaggcauauccugggaccuggggguggaggaugcuagcgagucuaaacuacucacuguaucaguuauggaccugagucagauguacagccccguguucgaauaucuuuccggagaucgccaagucgaggaauggccuaaggccaccuguacaggcgacugcccagagagaugugguugcacuucuucgaccuguuugcauaaagaauggccccacagcaggaacuggcggugcaacccgacauggugcuggggcguggggaccggauguacuugcuguggccuggaugucaaggaccucuuuacggauuacauguucgugaaauggaagguugaguauaucaagacagaggcgauugugugcguagaacugaccucccaggagcgccaguguucacuuaucgaagccgggacuagauuuaaucugggaccugucaccaucacauugagugagcccaggaacauucaacagaaacucccaccugagauaaucacccugcauccccguauugaagaggguuucuucgacuuaaugcacgugcagaagguucugucugcaagcacugugugcaaacuacaguccuguacacacggcgucccaggggaucuccaaguguaccauaucggaaaucugcuuaagggcgacaaaguaaacggucacuugauucauaagaucgaaccccacuuuaauacgucauggaugagcugggacgggugcgaucuggacuauuacuguaacaugggcgauuggccuucuugcaccuacacuggagugacacagcauaaucacgcuuccuucguuaaccuccugaauauagagaccgacuauacaaagaacuuucacuuccauaguaaacgggucacugcccacggcgauaccccacaguuagaccugaaggcucgaccgacguacggggccggagaaaucaccgugcuuguggaggucgcagauauggaguugcauacuaaaaagauugaaaucagcggucucaaauuugccucucuggcuuguacuggcugcuaugcgugcuccucaaguauuagcuguaagguuagaauccacguggacgagcccgaugaacuaaccgugcacguaaagucggacgauccugacgucguggcagccuccucuagccugauggcuaggaaacucgaguucgggacagauucaacuuuuaaggccuucagugcaaugccaaaaaccucccugugcuuuuacauaguugaacgcgagcauuguaagucuugcagcgaggaagacacgaaaaagugugugaauacaaaacuugagcagccccaauccauuuugaucgaacacaagggaaccauuaucggcaagcagaacucaacuugcacagccaaagcuagcuguuggcuggagagugucaagucuuucuuuuauggucucaaaaauauguuauccgggauauucggcaacguguuuaugggaaucuuccuguuccuugccccuuuuauucuguugauccucuucuuuauguucggcuggcggauucuguuuugcuucaaguguugcagaaggacccgcgggcuauuuaaauaccgacaucugaaggacgaugaagagacuggauaucggcguaucauagagaagcucaauaacaaaaagggcaaaaacaagcugcuugacggugaaagauuggcagaugggaggauugcggagcuguucagcaccaaaacacacaucggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17048 - RNA, 1411 nt, Artificial Sequence
  mRNA product Design2 comprising derived and/or modified sequence from CCHVF(10200)__U39455.2__IgE-leader_Gn (opt3)
ggggcgcugccuacggagguggcagccaucuccuucucggcaucaagcuuaccauggacuggaccuggauccuguuccucguggccgcugcaacaagaguccacagcuccgaggaacccucugaugacugcguuucaaggacucagcuucugcggacggagaccgccgaaauucauggcgauaacuacgggggaccuggugacaagauaacaaucuguaauggcaguacuauuguggaucaacgcuuggggagcgaguuaggaugcuauaccaucaaccgaguacguuccuuuaaacugugugaaaauucugcgacaggcaagaacugcgagauugacucggugccagucaaauguagacaggguuacugccuaaggaucacccaggaggggcggggacacgugaagcucucacgcggcagcgaaguugugcuggaugcuugugacacaaguugcgagauaaugaucccgaaaggcacuggggauauucuugucgacuguuccggaggucagcaacauuuccugaaggauaauuugaucgaccucggcugccccaagauuccucugcuggggaaaauggccaucuauauauguagaaugucuaaccacccaaagaccacgauggcauuucucuucugguuuagcuucggauacgugauuacuugcaucuuaugcaaagccaucuuuuaucugcuuauuaucguaggcaccuuggguaggcggcugaagcaguaccgcgaacuaaaaccccagacauguacuauuugcgagaccacaccuguuaaugcuauagaugcagagaugcaugaccucaacuguuccuauaauaucugcccauacugugccucacgacugaccagugacgggcuugcuagacacgugauucagugccccaagaggaaggaaaaagucgaggaaacggagcuguacuugaaccucgaacggaucccuuggguggugcguaagcuguuacaagucagcgagucuacuggaguugcccugaaacgcuccucauggcucauagugcuucugguauuguucacagugagccuaaguccaguccagucugcgccgauuggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17049 - RNA, 2371 nt, Artificial Sequence
  mRNA product Design2 comprising derived and/or modified sequence from CCHVF(10200)__U39455.2__IgE-leader_Gc (opt3)
ggggcgcugccuacggagguggcagccaucuccuucucggcaucaagcuuaccauggacuggaccuggauccuguuccucguggccgcugcaacaagaguccacagcuuucuugauuccacugccaagggcaugaaaaaccuguuaaauucuacgucauuggagaccagucugagcauugaagcgcccuggggagcuauaaacguucaguccacauacaagccuacugugucuaccgccaauaucgcacuaucguggucaagcguagagcauagggggaacaaaauucucgugaguggucgguccgaaucuaucaugaagcuggaggaacgcacaggcauuagcugggaccuuggggucgaggaugccuccgagucaaaacuguugaccgugaguguuauggaccucagccagauguauucuccaguguucgaauaccuguccggagaucgacaggucgaggaauggccgaaggcuacuugcacaggcgacugucccgagcguugcgguuguaccucaagcacgugccugcacaaggaguggccucauaguagaaauuggagguguaacccaacuuggugcuggggaguggggaccggcuguacaugcuguggccucgauguaaaagacuuauuuacugauuauauguucguuaaguggaaaguggaauacaucaagaccgaggcaauagucugcguggaacugacaucucaggagcggcaguguucccuuaucgaagccgggacccgcuuuaauuugggacccgugacgauuacucugagcgagccuagaaacauccaacagaaacuaccacccgagauuaucacacuccacccuaggauagaagaggguuucuuugaccugaugcauguccagaagguucuuucggcuucuaccgugugcaagcugcaguccugcacucacggcguaccaggggauuugcaaguguaucacauuggaaaucuccugaaaggcgacaaggucaacggucauuuaauccacaaaauugaaccgcauuucaauacaucauggaugaguugggaugggugugaccuggacuacuauugcaacaugggagauuggcccagcuguaccuacacgggcgugacccagcacaaucacgccuccuuuguuaaccuccuuaauaucgagacagacuacacuaagaacuuccauuuucacucuaaacgggugaccgcgcauggcgauacaccucagcuggacuugaaggcacgcccaacuuauggggccggagaaaucaccguccuaguggagguagcugauauggagcugcacaccaaaaagauugaaauaagcggucucaaguucgccucacuggcaugcacaggcuguuacgcuugcaguuccagcaucucuuguaaaguucgaauccauguggacgagcccgaugaacuuacuguccacgugaagucagacgauccugacgucguggccgcgaguagcucccugauggccagaaaauuggaguuugggacggauucuacauucaaggcauucucggcuaugccaaaaaccagccucugcuuuuauauuguugaaagggagcacuguaaguccugcucagaggaagacacuaagaaaugugugaacaccaagcuggagcagccccaaaguauauuaauugaacauaaaggaacaaucaucggcaagcaaaauucuaccugcacugccaaagcuagcugcuggcuggaguccguaaagucauucuuuuacggucuaaagaacaugcucagcgggauuuucggcaaugucuuuaugggaaucuuccuguuucuugccccguucauuuugcugauacucuuuuucauguuuggcuggcggauccuguucuguuuuaaaugcugucgucgcacaagagggcuuuucaaguauaggcaccugaaagacgaugaggaaacgggauaccggcgaauuaucgagaaguugaacaauaaaaaggguaagaacaaacuccuggacggcgaacgcuuagcagaugggagaaucgccgagcuguucucuaccaagacucauauuggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17050 - RNA, 1831 nt, Artificial Sequence
  mRNA product Design2 comprising derived and/or modified sequence from CCHFV(10200)__NC_005302.1/U88410.1__N (opt1) R6082
ggggcgcugccuacggagguggcagccaucuccuucucggcaucaagcuuaccauggagaacaagaucgaggugaacaacaaggacgagaugaaccgcugguucgaggaguucaagaagggcaacgggcuggucgacaccuucaccaacagcuacuccuucugcgagagcgugcccaaccucgaccgguucguguuccagauggccuccgccacggacgacgcgcagaaggacagcaucuacgccuccgcccuggucgaggccaccaaguucugcgccccgaucuacgagugcgcgugggugagcuccaccggcaucgugaagaaggggcuggagugguucgagaagaacgccggcaccaucaagagcugggacgaguccuacacggagcucaaggucgacgugcccaagaucgagcagcugaccggguaccagcaggccgcccugaaguggcgcaaggacaucggcuuccgggugaacgcgaacaccgccgcccucagcaacaagguccuggccgaguacaaggugcccggcgagaucgugauguccgucaaggagaugcugagcgacaugauccgccggcgcaaccucauccugaaccgcgggggcgacgagaacccccgggggccggugucccacgagcacguggacuggugccgggaguucgucaagggcaaguacaucauggccuucaacccgcccuggggcgacaucaacaagagcgggcgcuccggcaucgcgcugguggccaccgggcucgccaagcuggccgagacggagggcaaggggaucuucgacgaggccaagaagaccguggaggcgcugaacggcuaccucgacaagcacaaggacgaggucgaccgggccagcgccgacuccaugaucaccaaccugcugaagcacaucgccaaggcccaggagcucuacaagaacagcuccgcgcugcgcgcccagagcgcccagaucgacaccgccuucagcuccuacuacuggcuguacaaggccggcgugacgcccgagaccuuccccaccgugagccaguuccucuucgagcuggggaagcagccccggggcaccaagaagaugaagaaggcgcugcucuccacgcccaugaagugggggaagaagcuguacgagcuguucgccgacgacagcuuccagcagaaccgcaucuacaugcaccccgccguccucaccgccggccggaucuccgagaugggggugugcuucggcaccaucccgguggcgaaccccgacgacgccgcccagggcagcgggcacaccaaguccauccugaaccugcgcacgaacaccgagaccaacaaccccugcgccaagaccaucgucaagcuguucgaggugcagaagacgggcuucaacauccaggacauggacaucgucgccagcgagcaccuccugcaccagucccucguggggaagcagagccccuuccagaacgcguacaacgugaagggcaacgccaccuccgccaacaucaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17051 - RNA, 1831 nt, Artificial Sequence
  mRNA product Design2 comprising derived and/or modified sequence from CCHFV(Turkey-Kelkit06)__GQ337053.1__N (opt1)
ggggcgcugccuacggagguggcagccaucuccuucucggcaucaagcuuaccauggagaacaagaucgaggugaacagcaaggacgagaugaacaagugguucgaggaguucaagaagggcaacgggcugauggacaccuucaccaacuccuacagcuucugcgagaacguccccaaccucgacaaguucguguuccagauggccuccgccacggacgacgcgcagaaggacagcaucuacgccuccgcccugguggaggccaccaaguucugcgccccgaucuacgagugcgcgugggucagcuccaccggcaucgugaagaaggggcuggagugguucgagaaggacagcggcaccaucaaguccugggacgagaacuacgccgagcucaagguggacguccccaagaucgagcagcuggccaacuaccagcaggccgcgcugaaguggcgcaaggacaucggguuccgggugaacgccaacacggccgcccucagcaacaaggugcuggccgaguacaagguccccggcgagaucgugauguccgugaaggagaugcugagcgacaugauccgccggcgcaaccucauccugaaccggggcggggacgagaacccccgcggcccggucucccgggagcacguggaguggugccgcgaguucgugaaggggaaguacaucauggcguucaacccgcccuggggcgacaucaacaagagcgggcgguccggcaucgcccuggucgccaccggccucgccaagcuggccgagaccgaggggaagggcguguucgacgaggcgaagaagaccguggaggcccugaacggguaccucgacaagcaccgcgacgaggucgacaaggccagcgccgacuccaugaucacgaaccugcccaagcacaucgccaaggcgcaggagcuguacaagaacagcuccgcccuccgggcccagggcgcccagaucgacacccccuucagcagcuucuacuggcuguacaaggccggcgugacccccgagaccuuccccacgaucucccaguuccuguucgagcucggggagcagccccgcggcaccaagaagaugaagaaggcgcugcugagcaccccgaugaagugggggaagaagcucuacgagcuguucgccgacgacuccuuccagcagaaccggaucuacaugcaccccgccgugcugaccgccggccgcaucagcgagaugggggucugcuucggcacgauccccguggcgaaccccgacgacgccgcccagggcuccgggcacaccaagagcauccucaaccugcggaccuccaccgagacgaacaacccgugcgccaagaccaucgugaagcuguucgagauccaggagaccggcuucaacauccaggacauggacaucgucgccagcgagcaccuccugcaccaguccaucguggggaagcagagccccuuccagaacgcguacaacgucaagggcaacgccaccuccgccaacaucaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17052 - RNA, 5437 nt, Artificial Sequence
  mRNA product Design2 comprising derived and/or modified sequence from CCHFV(10200)__U39455.2__GP (opt1) R6076
ggggcgcugccuacggagguggcagccaucuccuucucggcaucaagcuuaccaugcacaucagccugauguacgccauccucugccugcagcugugcggccucggggagacccacggcucccacaacgagacccgccacaacaagacggacaccaugaccacccacggggacaaccccagcuccgagccgcccgugagcacggcccuguccaucacccuggaccccagcaccgucacccccacgaccccggcguccggccucgaggggagcggcgagguguacaccuccccgcccaucaccacgggcagccugccccuguccgagaccacccccgagcuccccgugaccacggggaccgacacccugagcgccggcgacgucgaccccuccacccagacggccgggggcaccagcgcccccaccgugcggaccucccugccgaacagccccuccacgcccagcacgccccaggacacccaccacccggugcgcaaccuccuguccgucaccagccccgggcccgacgagaccagcacccccuccggcaccggcaaggagagcuccgccaccagcuccccgcaccccgugagcaaccggccgcccacgccgcccgcgaccgcccaggggcccaccgagaacgacucccacaacgccaccgagcaccccgagagccugacgcaguccgccacccccggccucaugaccagccccacccagaucgugcacccccaguccgcgaccccgaucacgguccaggacacccaccccagccccaccaaccgcuccaagcggaaccugaagauggagaucauccugacccucagccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgcccggcacccucuccaccaccgagagcacgccggccgggcugcccaccgccgagcccuucaaguccuacuucgccaagggcuuccugagcaucgacuccggcuacuacagcgccaagugcuacagcgggaccuccaacagcggccuccagcugaucaacaucacccgccacuccacgcggaucguggacacccccgggccgaagaucaccaaccugaagaccaucaacugcaucaaccucaaggcgagcaucuucaaggagcaccgcgaggucgagaucaacgugcugcugccccagguggccgucaaccucuccaacugccacguggugaucaagagccacgucugcgacuacucccuggacaucgacggcgccgugcggcugccccacaucuaccacgaggggguguucauccccggcacguacaagaucgucaucgacaagaagaacaagcucaacgaccgcugcacccuguucaccgacugcgugaucaagggccgggaggugcgcaaggggcagagcguccugcggcaguacaagaccgagauccgcaucggcaaggccuccacgggguuccggcgccuccugagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcagggcaagaccaucgaggccuaccgggcccgcgagggguacaccuccaucugccucuucguccugggcagcauccuguucaucguguccugccucaugaaggggcugguggacagcgucggcaacuccuucuuccccggccugagcaucugcaagacgugcagcaucuccagcaucaacggguucgagaucgagucccacaagugcuacugcagccucuucugcugcccguacugccggcacugcuccaccgacaaggagauccacaagcugcaccugagcaucugcaagaagcgcaagaccggcuccaacgugaugcucgccgugugcaagcugaugugcuuccgcgcgaccauggaggucagcaaccgggcccuguucauccgcuccaucaucaacacgaccuucgugcucugcauccugauccuggccgugugcgucgugagcaccuccgccguggagauggagaaccuccccgccgggaccugggagcgggaggaggaccugacgaacuucugccaccaggagugccaggucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17053 - RNA, 5437 nt, Artificial Sequence
  mRNA product Design2 comprising derived and/or modified sequence from CCHFV(IbAr10200)__AF467768.2__GP (opt1)
ggggcgcugccuacggagguggcagccaucuccuucucggcaucaagcuuaccaugcacaucagccugauguacgccauccucugccugcagcugugcggccucggggagacccacggcucccacaacgagacccgccacaacaagacggacaccaugaccacccccggggacaacccgagcuccgagccgcccgugagcacggcccuguccaucacccuggaccccagcaccgucacccccacgacccccgcguccggccucgaggggagcggcgagguguacaccuccccgcccaucaccacgggcagccugccccuguccgagaccacccccgagcuccccgugaccacggggaccgacacccugagcgccggcgacgucgaccccuccacccagacggccgggggcaccagcgccccgaccgugcggaccucccugcccaacagccccuccacgcccagcaccccgcaggacacccaccaccccgugcgcaaccuccuguccgucaccagccccgggcccgacgagacgagcacccccuccggcaccggcaaggagagcuccgccaccagcuccccgcaccccgugagcaaccggcccccgacgccgcccgcgaccgcccaggggcccaccgagaacgacucccacaacgccaccgagcaccccgagagccugacgcaguccgccacccccggccucaugaccagccccacccagaucgugcacccgcaguccgcgacccccaucacgguccaggacacccaccccagccccaccaaccgcuccaagcggaaccugaagauggagaucauccugacccucagccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgccgggcacccucuccaccaccgagagcacgcccgccgggcugcccaccgccgagcccuucaaguccuacuucgccaagggcuuccugagcaucgacuccggcuacuacagcgccaagugcuacagcgggaccuccaacagcggccuccagcugaucaacaucacccgccacuccacgcggaucguggacaccccggggcccaagaucaccaaccugaagaccaucaacugcaucaaccucaaggcgagcaucuucaaggagcaccgcgaggucgagaucaacgugcugcugccccagguggccgucaaccucuccaacugccacguggugaucaagagccacgucugcgacuacucccuggacaucgacggcgccgugcggcugccccacaucuaccacgaggggguguucaucccgggcacguacaagaucgucaucgacaagaagaacaagcucaacgaccgcugcacccuguucaccgacugcgugaucaagggccgggaggugcgcaaggggcagagcguccugcggcaguacaagaccgagauccgcaucggcaaggccuccacggggagccggcgccuccuguccgaggagcccagcgacgacugcaucucccggacccagcugcuccgcaccgagaccgccgagauccacggcgacaacuacgggggccccggcgacaagaucacgaucugcaacgggagcaccaucguggaccagcgccugggcuccgagcuggggugcuacaccaucaaccggguccgcagcuucaagcugugcgagaacuccgcgaccggcaagaacugcgagaucgacagcgugcccgugaagugccggcagggcuacugccuccgcaucacgcaggaggggcggggccacgucaagcugagccgcggguccgagguggugcuggacgccugcgacaccagcugcgagaucaugaucccgaagggcaccggggacauccucgucgacugcuccggcggccagcagcacuuccugaaggacaaccugaucgaccucgggugccccaagaucccccugcugggcaagauggccaucuacaucugccggaugagcaaccaccccaagaccacgauggccuuccucuucugguucuccuucggguacgugaucacgugcauccugugcaaggccaucuucuaccugcucaucaucgugggcacccuggggaagcgccugaagcaguaccgggagcucaagccgcagaccugcaccaucugcgagacgacccccgucaacgcgaucgacgccgagaugcacgaccugaacugcagcuacaacaucugccccuacugcgccucccgccugaccagcgacggccucgcccggcacgugauccagugccccaagcgcaaggagaagguggaggagaccgagcuguaccugaaccucgagcggaucccgugggucgugcgcaagcugcugcaggucuccgagagcacgggcgucgcccucaagcgguccagcuggcugaucgugcugcucgugcuguucaccgucucccugagccccgugcaguccgcgcccaucgggcagggcaagaccaucgaggccuaccgcgcccgggagggguacaccagcaucugccucuucgugcugggcuccauccuguucaucgucagcugccucaugaaggggcugguggacuccgugggcaacagcuucuucccgggccugagcaucugcaagacgugcuccaucagcuccaucaacggguucgagaucgagagccacaagugcuacugcucccucuucugcugccccuacugccgccacugcagcaccgacaaggagauccacaagcugcaccuguccaucugcaagaagcggaagaagggcagcaacgucaugcucgccgugugcaagcugaugugcuuccgcgcgaccauggagguguccaaccgcgcccuguucauccggagcaucaucaacaccacguucguccucugcauccugauccuggccgugugcguggucuccaccagcgccguggagauggagaaccuccccgccgggaccugggagcgcgaggaggaccugaccaacuucugccaccaggagugccaggugacggagaccgagugccugugccccuacgaggcgcucguccugcggaagccgcuguuccucgacuccaccgccaagggcaugaagaaccugcugaacagcaccucccucgagacgagccuguccaucgaggcccccuggggcgccaucaacgugcagagcaccuacaagcccaccguguccaccgccaacaucgcgcugagcuggagcuccgucgagcaccgcgggaacaagauccucgugagcggccgguccgagagcaucaugaagcuggaggagcgcacggggaucuccugggaccugggcguggaggacgccagcgaguccaagcuccugaccgucagcgugauggaccugucccagauguacagccccguguucgaguaccucuccggggaccggcaggucggcgaguggccgaaggccacgugcaccggcgacugccccgagcgcugcgggugcacgagcuccacgugccugcacaaggaguggccccacagccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccucccaggagcggcagugcagccugaucgaggccggcacgcgcuucaaccucggcccggugaccaucacccuguccgagccccggaacauccagcagaagcugccgcccgagaucaucacccuccacccccgcaucgaggagggguucuucgaccugaugcacgugcagaagguccugagcgcguccaccgugugcaagcuccagagcugcacgcacggcguccccggggaccugcaggucuaccacaucggcaaccugcucaagggggacaaggugaacggccaccugauccacaagaucgagccccacuucaacaccagcuggauguccugggacggcugcgaccuggacuacuacugcaacaugggggacuggcccagcugcaccuacaccggcgucacgcagcacaaccacgccuccuucgugaaccuccugaacaucgagaccgacuacaccaagaacuuccacuuccacagcaagcgggugaccgcccacggggacacgccgcagcuggaccucaaggcccgccccaccuacggcgcgggggagaucaccguccugguggagguggccgacauggagcugcacaccaagaagaucgagaucuccggccucaaguucgccagccuggccugcacgggcugcuacgccugcuccagcgggaucuccugcaagguccggauccacguggacgagcccgacgagcugaccgugcacgucaagagcgacgaccccgacgugguggcggccuccagcucccucauggcccgcaagcuggaguucggcaccgacagcaccuucaaggccuucuccgccaugccgaagacgagccugugcuucuacaucgucgagcgggagcacugcaaguccugcagcgaggaggacaccaagaagugcgugaacaccaagcucgagcagccccaguccauccugaucgagcacaaggggaccaucaucggcaagcagaacagcacgugcaccgcgaaggccagcugcuggcuggaguccgugaaguccuucuucuacggccugaagaacaugcucuccgggaucuucggcaacgucuucauggggaucuuccuguuccuggcccccuucauccuccugauccuguucuucauguucggcuggcgcauccucuucugcuucaagugcugccggcgcacccgcgggcuguucaaguaccggcaccugaaggacgacgaggagaccggcuaccgccggaucaucgagaagcucaacaacaagaagggcaagaacaagcugcuggacggggagcgccucgccgaccggcgcaucgccgagcuguucagcacgaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17054 - RNA, 5449 nt, Artificial Sequence
  mRNA product Design2 comprising derived and/or modified sequence from CCHFV(Turkey-Kelkit06)__GQ337054.1__GP (opt1) R6075
ggggcgcugccuacggagguggcagccaucuccuucucggcaucaagcuuaccaugcccaccaacaucaugcacaccccgcuggugugcuucauccucuaccugcagcugcucugccugggcggggcccacggccagcugaacgccacggagcacaacgggaccaacaacaccaccgcgcccggcgccagccagucccccaagcccccgaugagcacgaccccgccccacgcccccgaguccagcaccaucaagccgaccacgcccaucuccgaggccgaggggagcggcgagaccaccuccccgcccaacaccacgcagggccucagcuccccggagaccaccagcgagcgccccgccaccacguccaucagcaccuccagcaccgacuccaccaaccccacgacccagaugaccgacaacacccccacgccgaccgucagcaccucccccagcuccagccccagcacccccuccacgccgcaggggauccaccaccccgcgcggagccugcuguccgugagcucccccaagaccgugaccacccccacgccgaccagccccggcgagauguccagcgagaccuccagccagcacuccgccaugagccgcauccccaccccgcacacggccacccgggucuccaccgagaucaccaaccaccgcaccccgcggcagagcgaguccagcgcccagcagacgacccccucccccaugaccagcccggcgcaguccauccuccugaugagcgccgcccccaccgccgugcaggacauccaccccagccccacgaaccgcuccaagcggaaccuggagaccgagaucauccucacccugagccaggggcugaagaaguacuacggcaagauccucaagcugcugcaccucacccuggagcaggacacggaggggcugcucgaguggugcaagggcaaccugggcuccaacugcgacgacgacuucuuccagaagcgcaucgaggaguucuucaugaccggggagugcuacuucaacgaggugcugcaguucaagacccucagcacccuguccccgacggagcccagccacgcccggcugcccaccgcggagcccuucaaguccuacuucgccaagggcuuccucagcaucgacuccggguacuucagcgccaagugcuacccgcgcuccagcgccuccggccugcagcugaucaacgucacccagcaccccgcccggaucgcggagacccccggccccaagacgaccagccucaagaccaucaacugcaucaaccugcgcgccuccguguucaaggagcaccgggagguggagaucaacguccugcucccgcagaucgccgugaaccugagcaacugccacguggucaucaacucccacgugugcgacuacagccuggacaccgacgggcccgugcgccucccccggaucuaccacgagggcacguucauccccgggaccuacaagaucgucaucgacaagaagaacaagcugaacgaccgcugcacccuggugaccaacugcgugaucaagggccgggagguccgcaaggggcagagcgugcuccggcaguacaagacggagaucaagaucggcaaggccuccaccggcuuccgcaagcugcugagcgaggagccgggggacgacugcaucucccggacccagcuccugcgcaccgagacggccgagauccacgacgacaacuacggcgggcccggcgacaagaucaccaucugcaacgggagcaccaucguggaccagcgccugggcuccgagcucggcugcuacaccaucaaccgggucaagagcuucaagcugugcaagaacuccgcgacggggaagaccugcgagguggacagcacccccgugaagugccgccagggcuucugccugaagaucacccaggaggggcggggccacgucaagcucucccgcgggagcgaggugguccuggacgccugcgacuccagcugcgaggugaugauccccaagggcacgggcgacauccugguggacugcuccgggggccagcagcacuuccugaaggacaaccucaucgaccuggggugcccgcacaucccccugcucggccggauggccaucuacaucugccgcaugagcaaccacccccggaccaccauggccuuccuguucugguucuccuucggcuacgucaucacgugcaucuucugcaaggcccuguucuacagccucaucaucaucgggacccugggcaagaagaucaagcaguaccgcgagcugaagccccagacgugcaccaucugcgagaccgcgccggugaacgccaucgacgccgagaugcacgaccucaacugcuccuacaacaucugccccuacugcgccagccggcugaccuccgacgggcuggcgcgccacgugacgcagugccccaagcggaaggagaaggucgaggagaccgagcucuaccugaaccuggagcgcaucccguggaucgugcggaagcuccuccaggugagcgagagcaccggcgucgcccugaagcgcuccagcuggcucaucgugcugcuggugcuccugaccgucucccugagccccgugcaguccgcccccguggggcacggcaagacgaucgagaucuaccagacccgggagggcuucgccagcaucugccucuucaugcugggguccauccuguucaucgucagcugccucgugaagggccugguggacuccgucagcgaguccuucuuccccgggcugagcgugugcaagaccugcuccaucggcagcgugaacggguucgagaucgagucccacaagugcuacugcagccucuucugcugcccguacugccgccacugcuccgccgaccgggagauccaccagcugcaccugagcaucugcaagaagcgcaagaccggcuccaacgucaugcucgcggugugcaagcggaugugcuuccgcgccacgaucgaggccagccgccgggcccugcugauccgcagcaucaucaacaccaccuucgugaucugcauccucacccugacgaucugcgucguguccaccagcgccguggagauggagaaccugcccgcgggcaccugggagcgggaggaggaccucaccaacuucugccaccaggagugccaggucacggagaccgagugccugugccccuacgaggcccuggugcuccgcaagccccuguuccuggacuccaucgugaaggggaugaagaaccuccugaacagcaccucccuggagaccagccucuccaucgaggccccguggggcgccaucaacguccagagcacguucaagcccaccguguccaccgccaacaucgcgcugagcugguccagcgugguccaccgggggaacaagauccuggugaccggccgcuccgagagcaucaugaagcucgaggagcggacggggguguccugggaccugggcgucgaggacgccagcgaguccaagcugcucaccgugagcaucauggaccugucccagauguacagccccguguucgaguaccugagcggcgaccgccaggucgaggaguggcccaaggcgaccugcaccggggacugcccggagcggugcggcugcacguccagcacgugccuccacaaggaguggucccacagccgcaacuggcggugcaaccccaccuggugcuggggcgugggcaccgggugcacgugcugcggcguggacgucaaggaccuguucaccgaccacauguucgugaaguggaagguggaguacaucaagaccgaggccaucgucugcguggcgcugaccucccaggagcgccagugcagccucaucgaggccggcacccgguucaaccuggggcccgugacgaucacccuguccgagccccgcaacauccagcagaagcucccgcccgagaucaucacccugcaccccaagaucgaggagggcuucuucgaccugaugcacguccagaaggugcucagcgccuccaccgugugcaagcugcagagcugcacgcacgggauccccggcgaccugcaggucuaccacaucggcaaccuccugaagggggaccgggugaacggccaccugauccacaagaucgagucccacuucaacaccagcuggauguccugggacgggugcgaccucgacuacuacugcaacaugggcgacuggccgagcugcaccuacaccggggucacgcagcacaaccacgccgccuucgugaaccugcugaacaucgagaccgacuacaccaagaccuuccacuuccacuccaagcgcgugacggcgcacggcgacaccccgcagcucgaccugaaggcccggcccaccuacggcgccgggggcaucaccguccugguggagguggccgacauggagcuccacacgaagaaggucgagaucagcgggcugaaguucgccucccuggcgugcaccggcugcuacgccugcagcuccgggaucagcugcaaggugcgcauccacguggacgagcccgacgagcucaccguccacgucaagagcuccgacccggacguggucgccgccagcaccucccugauggcccggaagcuggaguucggcacggacagcaccuucaaggcguucuccgccaugcccaagaccagccucugcuucuacaucguggagcgcgaguacugcaaguccugcagcgaggacgacacccagaagugcguggacacgcggcuggagcagccccaguccauccugaucgagcacaagggcaccaucaucgggaagcagaacgacacgugcaccgccaaggccagcugcuggcucgaguccgucaagagcuucuucuacggccugaagaacaugcugggguccguguucggcaaccucuucaucgggauccugcuguuccucgcgcccuucgugcugcugguccuguucuucauguucggcuggaagauccucuucugcuucaagugcugccgccgcacgcggggccuguucaaguaccgccaccugaaggacgacgaggagaccggguaccggcgcaucaucgagcggcucaacagcaagaagggcaagaaccgccugcuggacggggaccggcucgccgaccgcaagaucgccgagcuguucuccaccaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17055 - RNA, 3961 nt, Artificial Sequence
  mRNA product Design2 comprising derived and/or modified sequence from CCHVF(10200)__U39455.2__SP-GP_Gn-NSm-Gc (opt1) R6077
ggggcgcugccuacggagguggcagccaucuccuucucggcaucaagcuuaccaugcacaucagccugauguacgccauccucugccugcagcugugcggccucggggagacccacggcucccacaacgagaccagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcagggcaagaccaucgaggccuaccgggcccgcgagggguacaccuccaucugccucuucguccugggcagcauccuguucaucguguccugccucaugaaggggcugguggacagcgucggcaacuccuucuuccccggccugagcaucugcaagacgugcagcaucuccagcaucaacggguucgagaucgagucccacaagugcuacugcagccucuucugcugcccguacugccggcacugcuccaccgacaaggagauccacaagcugcaccugagcaucugcaagaagcgcaagaccggcuccaacgugaugcucgccgugugcaagcugaugugcuuccgcgcgaccauggaggucagcaaccgggcccuguucauccgcuccaucaucaacacgaccuucgugcucugcauccugauccuggccgugugcgucgugagcaccuccgccguggagauggagaaccuccccgccgggaccugggagcgggaggaggaccugacgaacuucugccaccaggagugccaggucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17056 - RNA, 3934 nt, Artificial Sequence
  mRNA product Design2 comprising derived and/or modified sequence from CCHVF(10200)__U39455.2__IgE-leader_Gn-NSm-Gc (opt1) R6078
ggggcgcugccuacggagguggcagccaucuccuucucggcaucaagcuuaccauggacuggaccuggauccuguuccucguggccgccgcgacccgcguccacagcagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcagggcaagaccaucgaggccuaccgggcccgcgagggguacaccuccaucugccucuucguccugggcagcauccuguucaucguguccugccucaugaaggggcugguggacagcgucggcaacuccuucuuccccggccugagcaucugcaagacgugcagcaucuccagcaucaacggguucgagaucgagucccacaagugcuacugcagccucuucugcugcccguacugccggcacugcuccaccgacaaggagauccacaagcugcaccugagcaucugcaagaagcgcaagaccggcuccaacgugaugcucgccgugugcaagcugaugugcuuccgcgcgaccauggaggucagcaaccgggcccuguucauccgcuccaucaucaacacgaccuucgugcucugcauccugauccuggccgugugcgucgugagcaccuccgccguggagauggagaaccuccccgccgggaccugggagcgggaggaggaccugacgaacuucugccaccaggagugccaggucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17057 - RNA, 3355 nt, Artificial Sequence
  mRNA product Design2 comprising derived and/or modified sequence from CCHVF(10200)__U39455.2__IgE-leader_Gn-4aa-Gc (opt1) R6081
ggggcgcugccuacggagguggcagccaucuccuucucggcaucaagcuuaccauggacuggaccuggauccuguuccucguggccgccgcgacccgcguccacagcagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17058 - RNA, 1411 nt, Artificial Sequence
  mRNA product Design2 comprising derived and/or modified sequence from CCHVF(10200)__U39455.2__IgE-leader_Gn (opt1) R6079
ggggcgcugccuacggagguggcagccaucuccuucucggcaucaagcuuaccauggacuggaccuggauccuguuccucguggccgccgcgacccgcguccacagcagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17059 - RNA, 2371 nt, Artificial Sequence
  mRNA product Design2 comprising derived and/or modified sequence from CCHVF(10200)__U39455.2__IgE-leader_Gc (opt1) R6080
ggggcgcugccuacggagguggcagccaucuccuucucggcaucaagcuuaccauggacuggaccuggauccuguuccucguggccgccgcgacccgcguccacagcuuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccuccacgugccugcacaaggaguggccccacagccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17060 - RNA, 1831 nt, Artificial Sequence; identical to SEQ ID NO: 17050
  mRNA product Design2 comprising derived and/or modified sequence from CCHFV(10200)__NC_005302.1/U88410.1__N (opt1)

SEQ ID NO: 17061 - RNA, 1831 nt, Artificial Sequence; identical to SEQ ID NO: 17051
  mRNA product Design2 comprising derived and/or modified sequence from CCHFV(Turkey-Kelkit06)__GQ337053.1__N (opt1)

SEQ ID NO: 17062 - RNA, 5437 nt, Artificial Sequence
  mRNA product Design2 comprising derived and/or modified sequence from CCHFV(10200)__U39455.2__GP (opt1)
ggggcgcugccuacggagguggcagccaucuccuucucggcaucaagcuuaccaugcacaucagccugauguacgccauccucugccugcagcugugcggccucggggagacccacggcucccacaacgagacccgccacaacaagacggacaccaugaccacccacggggacaaccccagcuccgagccgcccgugagcacggcccuguccaucacccuggaccccagcaccgucacccccacgaccccggcguccggccucgaggggagcggcgagguguacaccuccccgcccaucaccacgggcagccugccccuguccgagaccacccccgagcuccccgugaccacggggaccgacacccugagcgccggcgacgucgaccccuccacccagacggccgggggcaccagcgcccccaccgugcggaccucccugccgaacagccccuccacgcccagcacgccccaggacacccaccacccggugcgcaaccuccuguccgucaccagccccgggcccgacgagaccagcacccccuccggcaccggcaaggagagcuccgccaccagcuccccgcaccccgugagcaaccggccgcccacgccgcccgcgaccgcccaggggcccaccgagaacgacucccacaacgccaccgagcaccccgagagccugacgcaguccgccacccccggccucaugaccagccccacccagaucgugcacccccaguccgcgaccccgaucacgguccaggacacccaccccagccccaccaaccgcuccaagcggaaccugaagauggagaucauccugacccucagccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgcccggcacccucuccaccaccgagagcacgccggccgggcugcccaccgccgagcccuucaaguccuacuucgccaagggcuuccugagcaucgacuccggcuacuacagcgccaagugcuacagcgggaccuccaacagcggccuccagcugaucaacaucacccgccacuccacgcggaucguggacacccccgggccgaagaucaccaaccugaagaccaucaacugcaucaaccucaaggcgagcaucuucaaggagcaccgcgaggucgagaucaacgugcugcugccccagguggccgucaaccucuccaacugccacguggugaucaagagccacgucugcgacuacucccuggacaucgacggcgccgugcggcugccccacaucuaccacgaggggguguucauccccggcacguacaagaucgucaucgacaagaagaacaagcucaacgaccgcugcacccuguucaccgacugcgugaucaagggccgggaggugcgcaaggggcagagcguccugcggcaguacaagaccgagauccgcaucggcaaggccuccacgggguuccggcgccuccugagcgaggagccguccgacgacugcgugagccggacccagcugcuccgcaccgagaccgccgagauccacggcgacaacuacgggggccccggcgacaagaucacgaucugcaacggguccaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggcuacugccuccgcaucacgcaggaggggcggggccacgugaagcugagccgcgggagcgaggugguccuggacgccugcgacaccuccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagaccaccccggugaacgcgaucgacgccgagaugcacgaccugaacugcuccuacaacaucugccccuacugcgccagccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguucaccgugagccuguccccggugcagagcgcgcccaucgggcagggcaagaccaucgaggccuaccgggcccgcgagggguacaccuccaucugccucuucguccugggcagcauccuguucaucguguccugccucaugaaggggcugguggacagcgucggcaacuccuucuuccccggccugagcaucugcaagacgugcagcaucuccagcaucaacggguucgagaucgagucccacaagugcuacugcagccucuucugcugcccguacugccggcacugcuccaccgacaaggagauccacaagcugcaccugagcaucugcaagaagcgcaagaccggcuccaacgugaugcucgccgugugcaagcugaugugcuuccgcgcgaccauggaggucagcaaccgggcccuguucauccgcuccaucaucaacacgaccuucgugcucugcauccugauccuggccgugugcgucgugagcaccuccgccguggagauggagaaccuccccgccgggaccugggagcgggaggaggaccugacgaacuucugccaccaggagugccaggucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcuguccuggagcagcguggagcaccgggggaacaagauccucguguccggccgcagcgaguccaucaugaagcuggaggagcggaccgggaucagcugggaccugggcgucgaggacgccuccgagagcaagcuccugaccguguccgugauggaccugagccagauguacucccccgucuucgaguaccucagcggggaccgccagguggaggaguggcccaaggcgaccugcacgggcgacugcccggagcggugcggcugcaccuccagcacgugccugcacaaggaguggccccacucccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggucugcaagcuccaguccugcacccacggggugcccggcgaccuccagguguaccacaucgggaaccugcugaagggcgacaaggucaacgggcaccugauccacaagaucgagccccacuucaacaccagcuggaugagcugggacggcugcgaccuggacuacuacugcaacaugggcgacuggcccuccugcaccuacacgggggugacccagcacaaccacgccagcuucgugaaccuccugaacaucgagaccgacuacaccaagaacuuccacuuccacuccaagcgcgucacggcccacggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucuccugcaaggugcgcauccacguggacgagcccgacgagcugaccguccacgucaagagcgacgaccccgacgugguggcggccuccagcucccucauggcccggaagcuggaguucggcaccgacagcacguucaaggccuucuccgccaugcccaagaccagccugugcuucuacaucguggagcgcgagcacugcaaguccugcagcgaggaggacaccaagaagugcgugaacaccaagcucgagcagccgcaguccauccugaucgagcacaaggggacgaucaucggcaagcagaacuccacgugcaccgcgaaggccagcugcuggcuggagagcgucaagagcuucuucuacgggcugaagaacaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaccugaaggacgacgaggagaccggcuaccggcgcaucaucgagaagcucaacaacaagaaggggaagaacaagcugcuggacggcgagcggcucgccgacggccgcaucgccgagcuguucagcaccaagacccacaucgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17063 - RNA, 5437 nt, Artificial Sequence
  mRNA product Design2 comprising derived and/or modified sequence from CCHFV(IbAr10200)__AF467768.2__GP (opt1)
ggggcgcugccuacggagguggcagccaucuccuucucggcaucaagcuuaccaugcacaucagccugauguacgccauccucugccugcagcugugcggccucggggagacccacggcucccacaacgagacccgccacaacaagacggacaccaugaccacccccggggacaacccgagcuccgagccccccgugagcacggcccuguccaucacccuggaccccagcaccgucaccccgacgacccccgcguccggccucgaggggagcggcgagguguacaccuccccccccaucaccacgggcagccugccgcuguccgagaccacccccgagcuccccgugaccacggggaccgacacccugagcgccggcgacgucgaccccuccacccagacggccgggggcaccagcgccccgaccgugcggaccucccugcccaacagccccuccacgcccagcaccccgcaggacacccaccaccccgugcgcaaccuccuguccgucaccagccccgggcccgacgagacgagcaccccguccggcaccggcaaggagagcuccgccaccagcuccccccaccccgugagcaaccggcccccgacgccccccgcgaccgcccaggggcccaccgagaacgacucccacaacgccaccgagcacccggagagccugacgcaguccgccacccccggccucaugaccagccccacccagaucgugcacccgcaguccgcgacccccaucacgguccaggacacccaccccagccccaccaaccgcuccaagcggaaccugaagauggagaucauccugacccucagccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgccgggcacccucuccaccaccgagagcacgcccgccgggcugcccaccgccgagcccuucaaguccuacuucgccaagggcuuccugagcaucgacuccggcuacuacagcgccaagugcuacagcgggaccuccaacagcggccuccagcugaucaacaucacccgccacuccacgcggaucguggacaccccggggcccaagaucaccaaccugaagaccaucaacugcaucaaccucaaggcgagcaucuucaaggagcaccgcgaggucgagaucaacgugcugcugccccagguggccgucaaccucuccaacugccacguggugaucaagagccacgucugcgacuacucccuggacaucgacggcgccgugcggcugccccacaucuaccacgaggggguguucaucccgggcacguacaagaucgucaucgacaagaagaacaagcucaacgaccgcugcacccuguucaccgacugcgugaucaagggccgggaggugcgcaaggggcagagcguccugcggcaguacaagaccgagauccgcaucggcaaggccuccacggggagccggcgccuccuguccgaggagcccagcgacgacugcaucucccggacccagcugcuccgcaccgagaccgccgagauccacggcgacaacuacgggggccccggcgacaagaucacgaucugcaacgggagcaccaucguggaccagcgccugggcuccgagcuggggugcuacaccaucaaccggguccgcagcuucaagcugugcgagaacuccgcgaccggcaagaacugcgagaucgacagcgugcccgugaagugccggcagggcuacugccuccgcaucacgcaggaggggcggggccacgucaagcugagccgcggguccgagguggugcuggacgccugcgacaccagcugcgagaucaugaucccgaagggcaccggggacauccucgucgacugcuccggcggccagcagcacuuccugaaggacaaccugaucgaccucgggugccccaagaucccccugcugggcaagauggccaucuacaucugccggaugagcaaccaccccaagaccacgauggccuuccucuucugguucuccuucggguacgugaucaccugcauccugugcaaggccaucuucuaccugcucaucaucgugggcacccuggggaagcgccugaagcaguaccgggagcucaagccgcagaccugcaccaucugcgagacgacccccgucaacgcgaucgacgccgagaugcacgaccugaacugcagcuacaacaucugccccuacugcgccucccgccugaccagcgacggccucgcccggcacgugauccagugccccaagcgcaaggagaagguggaggagaccgagcuguaccugaaccucgagcggaucccgugggucgugcgcaagcugcugcagguguccgagagcacgggcgucgcccucaagcgguccagcuggcugaucgugcugcucgugcuguucaccgucucccugagccccgugcaguccgcgcccaucgggcagggcaagaccaucgaggccuaccgcgcccgggagggguacaccagcaucugccucuucgugcugggcuccauccuguucaucgucagcugccucaugaaggggcugguggacuccgugggcaacagcuucuucccgggccugagcaucugcaagacgugcuccaucagcuccaucaacggguucgagaucgagagccacaagugcuacugcucccucuucugcugccccuacugccgccacugcagcaccgacaaggagauccacaagcugcaccuguccaucugcaagaagcggaagaagggcagcaacgucaugcucgccgugugcaagcugaugugcuuccgcgcgaccauggagguguccaaccgcgcccuguucauccggagcaucaucaacaccacguucguccucugcauccugauccuggccgugugcguggucuccaccagcgccguggagauggagaaccuccccgccgggaccugggagcgcgaggaggaccugaccaacuucugccaccaggagugccaggugacggagaccgagugccugugccccuacgaggcgcucguccugcggaagccgcuguuccucgacuccaccgccaagggcaugaagaaccugcugaacagcaccucccucgagacgagccuguccaucgaggcccccuggggggccaucaacgugcagagcaccuacaagcccaccguguccaccgccaacaucgcgcugagcuggagcuccgucgagcaccgcggcaacaagauccucgugagcggccgguccgagagcaucaugaagcuggaggagcgcacggggaucuccugggaccugggcguggaggacgccagcgaguccaagcuccugaccgucagcgugauggaccugucccagauguacagccccguguucgaguaccucuccggggaccggcaggucggcgaguggccgaaggccaccugcaccggcgacugccccgagcgcugcgggugcacgagcuccaccugccugcacaaggaguggccccacagccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccucccaggagcggcagugcagccugaucgaggccggcacgcgcuucaaccucggcccggugaccaucacccuguccgagccccggaacauccagcagaagcugccccccgagaucaucacccuccacccgcgcaucgaggagggguucuucgaccugaugcacgugcagaagguccugagcgcguccaccgugugcaagcuccagagcugcacgcacggcguccccggggaccugcagguguaccacaucggcaaccugcucaagggggacaaggugaacggccaccugauccacaagaucgagccccacuucaacaccagcuggauguccugggacggcugcgaccuggacuacuacugcaacaugggggacuggcccagcugcaccuacaccggcgucacgcagcacaaccacgccuccuucgugaaccuccugaacaucgagaccgacuacaccaagaacuuccacuuccacagcaagcgggugaccgcccacggggacacgccgcagcuggaccucaaggcccgccccaccuacggcgcgggggagaucaccguccugguggagguggccgacauggagcugcacaccaagaagaucgagaucuccggccucaaguucgccagccuggccugcacgggcugcuacgccugcuccagcgggaucuccugcaagguccggauccacguggacgagcccgacgagcugaccgugcacgucaagagcgacgaccccgacgugguggcggccuccagcucccucauggcccgcaagcuggaguucggcaccgacagcaccuucaaggccuucuccgccaugccgaagacgagccugugcuucuacaucgucgagcgggagcacugcaaguccugcagcgaggaggacaccaagaagugcgugaacaccaagcucgagcagccccaguccauccugaucgagcacaaggggaccaucaucggcaagcagaacagcacgugcaccgcgaaggccagcugcuggcuggaguccgugaagagcuucuucuacggccugaagaacaugcucuccgggaucuucggcaacgucuucauggggaucuuccuguuccuggcccccuucauccuccugauccuguucuucauguucggcuggcgcauccucuucugcuucaagugcugccggcgcacccgcgggcuguucaaguaccggcaccugaaggacgacgaggagaccggcuaccgccggaucaucgagaagcucaacaacaagaagggcaagaacaagcugcuggacggggagcgccucgccgaccggcgcaucgccgagcuguucagcacgaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17064 - RNA, 5449 nt, Artificial Sequence
  mRNA product Design2 comprising derived and/or modified sequence from CCHFV(Turkey-Kelkit06)__GQ337054.1__GP (opt1)
ggggcgcugccuacggagguggcagccaucuccuucucggcaucaagcuuaccaugcccaccaacaucaugcacaccccgcuggugugcuucauccucuaccugcagcugcucugccugggcggggcccacggccagcugaacgccacggagcacaacgggaccaacaacaccaccgcgcccggcgccagccagucccccaagcccccgaugagcacgacccccccccacgcccccgaguccagcaccaucaagccgaccacgcccaucuccgaggccgaggggagcggcgagaccaccuccccccccaacaccacgcagggccucagcuccccggagaccaccagcgagcgccccgccaccacguccaucagcaccuccagcaccgacuccaccaaccccacgacccagaugaccgacaacacccccacgccgaccgucagcaccucccccagcuccagccccagcacccccuccacgccgcaggggauccaccaccccgcgcggagccugcuguccgugagcucccccaagaccgugaccacccccacgccgaccagccccggcgagauguccagcgagaccuccagccagcacuccgccaugagccgcauccccaccccccacacggccacccgggucuccaccgagaucaccaaccaccgcaccccgcggcagagcgaguccagcgcccagcagacgacccccucccccaugaccagcccggcgcaguccauccuccugaugagcgccgcccccaccgccgugcaggacauccaccccagccccacgaaccgcuccaagcggaaccuggagaccgagaucauccucacccugagccaggggcugaagaaguacuacggcaagauccucaagcugcugcaccucacccuggagcaggacacggaggggcugcucgaguggugcaagggcaaccugggcuccaacugcgacgacgacuucuuccagaagcgcaucgaggaguucuucaugaccggggagugcuacuucaacgaggugcugcaguucaagacccucagcacccuguccccgacggagcccagccacgcccggcugcccaccgcggagcccuucaaguccuacuucgccaagggcuuccucagcaucgacuccggguacuucagcgccaagugcuacccgcgcuccagcgccuccggccugcagcugaucaacgucacccagcaccccgcccggaucgcggagacccccggccccaagacgaccagccucaagaccaucaacugcaucaaccugcgcgccuccguguucaaggagcaccgggagguggagaucaacguccugcucccgcagaucgccgugaaccugagcaacugccacguggucaucaacucccacgugugcgacuacagccuggacaccgacgggcccgugcgccucccccggaucuaccacgagggcacguucauccccgggaccuacaagaucgucaucgacaagaagaacaagcugaacgaccgcugcacccuggugaccaacugcgugaucaagggccgggagguccgcaaggggcagagcgugcuccggcaguacaagacggagaucaagaucggcaaggccuccaccggcuuccgcaagcugcugagcgaggagccgggggacgacugcaucucccggacccagcuccugcgcaccgagacggccgagauccacgacgacaacuacggcgggcccggcgacaagaucaccaucugcaacgggagcaccaucguggaccagcgccugggcuccgagcucggcugcuacaccaucaaccgggucaagagcuucaagcugugcaagaacuccgcgacggggaagaccugcgagguggacagcacccccgugaagugccgccagggcuucugccugaagaucacccaggaggggcggggccacgucaagcucucccgcgggagcgaggugguccuggacgccugcgacuccagcugcgaggugaugauccccaagggcacgggcgacauccugguggacugcuccgggggccagcagcacuuccugaaggacaaccucaucgaccuggggugcccgcacaucccccugcucggccggauggccaucuacaucugccgcaugagcaaccacccccggaccaccauggccuuccuguucugguucuccuucggcuacgucaucaccugcaucuucugcaaggcccuguucuacagccucaucaucaucgggacccugggcaagaagaucaagcaguaccgcgagcugaagccccagacgugcaccaucugcgagaccgcgccggugaacgccaucgacgccgagaugcacgaccucaacugcuccuacaacaucugccccuacugcgccagccggcugaccuccgacgggcuggcgcgccacgugacgcagugccccaagcggaaggagaaggucgaggagaccgagcucuaccugaaccuggagcgcaucccguggaucgugcggaagcuccugcaggugagcgagagcaccggcgucgcccugaagcgcuccagcuggcucaucgugcugcuggugcuccugaccgucucccugagccccgugcaguccgcccccguggggcacggcaagacgaucgagaucuaccagacccgggagggcuucgccagcaucugccucuucaugcugggguccauccuguucaucgucagcugccucgugaagggccugguggacuccgucagcgaguccuucuuccccgggcugagcgugugcaagaccugcuccaucggcagcgugaacggguucgagaucgagucccacaagugcuacugcagccucuucugcugcccguacugccgccacugcuccgccgaccgggagauccaccagcugcaccugagcaucugcaagaagcgcaagaccggcuccaacgucaugcucgcggugugcaagcggaugugcuuccgcgccacgaucgaggccagccgccgggcccugcugauccgcagcaucaucaacaccaccuucgugaucugcauccucacccugacgaucugcgucguguccaccagcgccguggagauggagaaccugcccgcgggcaccugggagcgggaggaggaccucaccaacuucugccaccaggagugccaggucacggagaccgagugccugugccccuacgaggcccuggugcuccgcaagccccuguuccuggacuccaucgugaaggggaugaagaaccuccugaacagcaccucccuggagaccagccucuccaucgaggccccguggggcgccaucaacguccagagcacguucaagcccaccguguccaccgccaacaucgcgcugagcugguccagcgugguccaccgggggaacaagauccuggugaccggccgcuccgagagcaucaugaagcucgaggagcggacggggguguccugggaccugggcgucgaggacgccagcgaguccaagcugcucaccgugagcaucauggaccugucccagauguacagccccguguucgaguaccugagcggcgaccgccaggucgaggaguggcccaaggccaccugcaccggggacugcccggagcggugcggcugcacguccagcaccugccuccacaaggaguggucccacagccgcaacuggcggugcaaccccaccuggugcuggggggugggcaccgggugcacgugcugcggcguggacgucaaggaccuguucaccgaccacauguucgugaaguggaagguggaguacaucaagaccgaggccaucgucugcguggcgcugaccucccaggagcgccagugcagccucaucgaggccggcacccgguucaaccuggggcccgugacgaucacccuguccgagccccgcaacauccagcagaagcucccgcccgagaucaucacccugcaccccaagaucgaggagggcuucuucgaccugaugcacguccagaaggugcucagcgccuccaccgugugcaagcugcagagcugcacgcacgggauccccggcgaccugcaggucuaccacaucggcaaccuccugaagggggaccgggugaacggccaccugauccacaagaucgagucccacuucaacaccagcuggauguccugggacgggugcgaccucgacuacuacugcaacaugggcgacuggccgagcugcaccuacaccggggucacgcagcacaaccacgccgccuucgugaaccugcugaacaucgagaccgacuacaccaagaccuuccacuuccacuccaagcgcgugacggcgcacggcgacaccccccagcucgaccugaaggcccggcccaccuacggcgccgggggcaucaccguccugguggagguggccgacauggagcuccacacgaagaaggucgagaucagcgggcugaaguucgccucccuggcgugcaccggcugcuacgccugcagcuccgggaucagcugcaaggugcgcauccacguggacgagcccgacgagcucaccguccacgugaagagcuccgacccggacguggucgccgccagcaccucccugauggcccggaagcuggaguucggcacggacagcaccuucaaggcguucuccgccaugcccaagaccagccucugcuucuacaucguggagcgcgaguacugcaaguccugcagcgaggacgacacccagaagugcguggacacgcggcuggagcagccccaguccauccugaucgagcacaagggcaccaucaucgggaagcagaacgacaccugcaccgccaaggccagcugcuggcucgaguccgucaagagcuucuucuacggccugaagaacaugcugggguccguguucggcaaccucuucaucgggauccugcuguuccucgcgcccuucgugcugcugguccuguucuucauguucggcuggaagauccucuucugcuucaagugcugccgccgcacgcggggccuguucaaguaccgccaccugaaggacgacgaggagaccggguaccggcgcaucaucgagcggcucaacagcaagaagggcaagaaccgccugcuggacggggaccggcucgccgaccgcaagaucgccgagcuguucuccaccaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17065 - RNA, 3961 nt, Artificial Sequence
  mRNA product Design2 comprising derived and/or modified sequence from CCHVF(10200)__U39455.2__SP-GP_Gn-NSm-Gc (opt1)
ggggcgcugccuacggagguggcagccaucuccuucucggcaucaagcuuaccaugcacaucagccugauguacgccauccucugccugcagcugugcggccucggggagacccacggcucccacaacgagaccagcgaggagcccuccgacgacugcgugagccgcacgcagcugcugcggaccgagaccgccgagauccacggggacaacuacggcgggccgggcgacaagaucaccaucugcaacggcuccacgaucgucgaccagcgccucgggagcgagcugggcugcuacaccaucaaccgggugcgcuccuucaagcugugcgagaacagcgcgaccgggaagaacugcgagaucgacuccgugcccgucaagugccggcagggcuacugccuccgcaucacccaggaggggcggggccacgugaagcugagccgcggcuccgaggugguccuggacgccugcgacacgagcugcgagaucaugauccccaaggggaccggcgacauccucguggacugcuccgggggccagcagcacuuccugaaggacaaccugaucgaccucggcugccccaagaucccgcugcuggggaagauggccaucuacaucugccggaugagcaaccaccccaagaccaccauggccuuccucuucugguucuccuucggcuacgugaucacgugcauccugugcaaggccaucuucuaccugcucaucaucgucgggacccugggccgccggcugaagcaguaccgcgagcucaagccccagaccugcaccaucugcgagacgacccccgugaacgcgaucgacgccgagaugcacgaccugaacugcagcuacaacaucugcccguacugcgccucccggcugaccagcgacgggcucgcccgccacgugauccagugccccaagcggaaggagaaggucgaggagaccgagcuguaccugaaccucgagcgcauccccuggguggugcggaagcugcugcaggucuccgagagcacgggcguggcgcucaagcgcagcuccuggcugaucgugcugcucguccuguucaccgugagccugucccccgugcagagcgccccgaucggccaggggaagaccaucgaggccuaccgggcccgcgagggcuacaccuccaucugccucuucguccuggggagcauccuguucaucguguccugccucaugaagggccugguggacagcgucgggaacuccuucuuccccggccugagcaucugcaagacgugcuccaucagcuccaucaacggcuucgagaucgagagccacaagugcuacugcucccucuucugcugccccuacugccggcacugcagcaccgacaaggagauccacaagcugcaccuguccaucugcaagaagcgcaagaccgggagcaacgugaugcucgccgucugcaagcugaugugcuuccgcgcgaccauggagguguccaaccgggcccuguucauccgcagcaucaucaacacgaccuucgugcugugcauccucauccuggccgucugcguggugagcaccuccgccgucgagauggagaaccugcccgccggcaccugggagcgggaggaggaccucacgaacuucugccaccaggagugccaggugaccgagaccgagugccugugcccguacgaggcgcuggugcuccgcaagccccuguuccuggacagcaccgccaaggggaugaagaaccuccugaacuccacgagccuggagaccucccucagcaucgaggcccccuggggcgccaucaacguccaguccaccuacaagcccaccgugagcaccgccaacaucgcgcuguccuggagcuccguggagcaccgggggaacaagauccuggucagcggccgcuccgagagcaucaugaagcucgaggagcggacgggcaucuccugggaccuggggguggaggacgccagcgaguccaagcugcucaccgugagcgucauggaccugagccagauguacuccccgguguucgaguaccugagcggcgaccgccagguggaggaguggcccaaggccaccugcaccggggacugccccgagcggugcggcugcacguccagcaccugccuccacaaggaguggccccacucccgcaacuggcggugcaacccgaccuggugcuggggcgucgggaccggcugcacgugcugcgggcuggacgugaaggaccuguucaccgacuacauguucgugaaguggaaggucgaguacaucaagaccgaggccaucgugugcguggagcucaccagccaggagcgccagugcucccugaucgaggccggcacgcgguucaaccuggggcccgucaccaucacccucagcgagccccgcaacauccagcagaagcugcccccggagaucaucacccugcacccccggaucgaggagggcuucuucgaccucaugcacgugcagaaggugcuguccgcgagcacggucugcaagcugcaguccugcacccacggcgugcccggggaccuccagguguaccacaucggcaaccugcugaagggggacaaggucaacggccaccucauccacaagaucgagccgcacuucaacaccagcuggauguccugggacgggugcgaccuggacuacuacugcaacaugggcgacuggcccagcugcaccuacacgggcgugacccagcacaaccacgccuccuucgugaaccugcucaacaucgagaccgacuacaccaagaacuuccacuuccacagcaagcgcgucacggcccacggggacaccccccagcuggaccugaaggcccggcccaccuacggcgcgggggagaucaccgugcucguggaggucgccgacauggagcugcacacgaagaagaucgagaucuccggccugaaguucgccagccucgccugcaccgggugcuacgccugcuccagcagcaucuccugcaaggugcgcauccacguggacgagccggacgagcugaccguccacgugaagagcgacgaccccgacguggucgcggccuccagcucccugauggcccggaagcucgaguucggcaccgacagcacguucaaggccuucuccgccaugcccaagaccagccugugcuucuacaucguggagcgcgagcacugcaaguccugcagcgaggaggacaccaagaagugcgugaacaccaagcuggagcagccccaguccauccucaucgagcacaagggcacgaucaucgggaagcagaacagcaccugcaccgcgaaggccuccugcuggcuggagagcgucaaguccuucuucuacggccugaagaacaugcucagcgggaucuucggcaacguguucauggggaucuuccuguuccuggccccguucauccuccugauccuguucuucauguucggcuggcgcauccucuucugcuucaagugcugccggcgcacccggggccuguucaaguaccgccaccugaaggacgacgaggagaccggguaccggcgcaucaucgagaagcucaacaacaagaagggcaagaacaagcugcuggacggggagcggcucgccgacggccgcaucgccgagcuguucuccacgaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17066 - RNA, 3934 nt, Artificial Sequence
  mRNA product Design2 comprising derived and/or modified sequence from CCHVF(10200)__U39455.2__IgE-leader_Gn-NSm-Gc (opt1)
ggggcgcugccuacggagguggcagccaucuccuucucggcaucaagcuuaccauggacuggaccuggauccuguuccucguggccgccgcgacccgcguccacagcuccgaggagcccagcgacgacugcgugucccggacgcagcugcugcgcaccgagaccgccgagauccacggcgacaacuacgggggcccgggggacaagaucaccaucugcaacggcagcacgaucguggaccagcggcucggguccgagcugggcugcuacaccaucaaccgcguccggagcuucaagcugugcgagaacuccgccaccggcaagaacugcgagaucgacagcgugcccgugaagugccgccagggguacugccuccggaucacccaggagggccgcgggcacgucaagcugucccggggcagcgagguggugcuggacgccugcgacacguccugcgagaucaugauccccaaggggaccggcgacauccucgucgacugcagcggcgggcagcagcacuuccugaaggacaaccugaucgaccucggcugccccaagaucccgcugcuggggaagauggccaucuacaucugccgcauguccaaccaccccaagaccaccauggcguuccucuucugguucagcuucggcuacgugaucacgugcauccugugcaaggccaucuucuaccugcucaucaucgugggcacccuggggcggcgccugaagcaguaccgggagcucaagccccagaccugcaccaucugcgagacgacccccgucaacgccaucgacgccgagaugcacgaccugaacugcuccuacaacaucugcccguacugcgcgagccgccugaccuccgacggccucgcccggcacgugauccagugccccaagcgcaaggagaagguggaggagaccgagcuguaccugaaccucgagcggauccccugggucgugcgcaagcugcugcaggugagcgaguccacgggggucgcccucaagcggagcagcuggcugaucgugcugcucgugcuguucaccgucucccugagccccgugcaguccgccccgaucggccaggggaagaccaucgaggccuaccgcgcgcgggagggcuacaccagcaucugccucuucgugcugggcuccauccuguucaucgucagcugccucaugaaggggcugguggacuccgucggcaacagcuucuuccccgggcuguccaucugcaagacgugcagcaucuccagcaucaacggcuucgagaucgagucccacaagugcuacugcagccucuucugcugccccuacugccgccacugcuccaccgacaaggagauccacaagcugcaccugagcaucugcaagaagcgcaagaccggguccaacgugaugcucgccgugugcaagcugaugugcuuccgggccaccauggaggucagcaaccgcgcccuguucauccgguccaucaucaacacgaccuucgugcucugcauccugauccuggccgugugcgucgugagcaccagcgcgguggagauggagaaccugcccgccggcaccugggagcgcgaggaggaccucacgaacuucugccaccaggagugccaggucaccgagaccgagugccugugcccguacgaggcccuggugcuccggaagccccuguuccuggacuccaccgccaagggcaugaagaaccuccugaacagcacgucccuggagaccagccucuccaucgaggcccccuggggggcgaucaacgugcagagcaccuacaagcccaccgucuccaccgccaacaucgcccugagcugguccagcguggagcaccgcggcaacaagauccugguguccgggcggagcgaguccaucaugaagcucgaggagcgcacgggcaucagcugggaccugggggucgaggacgccuccgagagcaagcugcucaccguguccgugauggaccugagccagauguacagcccggucuucgaguaccuguccggcgaccggcagguggaggaguggcccaaggccaccugcaccggcgacugccccgagcgcugcgggugcacgagcuccaccugccuccacaaggaguggccccacagccggaacuggcgcugcaacccgaccuggugcuggggcguggggaccggcugcacgugcugcggccuggacgucaaggaccuguucaccgacuacauguucgugaaguggaagguggaguacaucaagaccgaggcgaucgucugcguggagcucaccucccaggagcggcagugcagccugaucgaggccgggacgcgcuucaaccugggccccgugaccaucacccucuccgagccccggaacauccagcagaagcugcccccggagaucaucacccugcacccccgcaucgaggagggguucuucgaccucaugcacguccagaaggugcugagcgccuccacggugugcaagcugcagagcugcacccacggcguccccggggaccuccagguguaccacaucggcaaccugcugaagggcgacaaggugaacgggcaccucauccacaagaucgagccgcacuucaacaccuccuggaugagcugggacggcugcgaccuggacuacuacugcaacaugggggacuggcccuccugcaccuacacgggcgucacccagcacaaccacgccagcuucgugaaccugcucaacaucgagaccgacuacaccaagaacuuccacuuccacuccaagcgggugacggcgcacggggacaccccccagcuggaccugaaggcccgccccaccuacggcgccggcgagaucaccguccucguggagguggccgacauggagcugcacacgaagaagaucgagaucagcgggcugaaguucgccucccucgcgugcaccggcugcuacgccugcagcuccagcaucagcugcaagguccggauccacguggacgagccggacgagcugaccgugcacgucaaguccgacgaccccgacgugguggccgccagcuccagccugauggcccgcaagcucgaguucgggaccgacuccacguucaaggcguucagcgccaugcccaagaccucccugugcuucuacaucgucgagcgcgagcacugcaagagcugcuccgaggaggacaccaagaagugcgugaacaccaagcuggagcagccccagagcauccucaucgagcacaagggcacgaucaucgggaagcagaacuccaccugcaccgccaaggccagcugcuggcuggaguccgugaagagcuucuucuacggccugaagaacaugcucuccggcaucuucgggaacgucuucaugggcaucuuccuguuccuggccccguucauccuccugauccuguucuucauguucggguggcggauccucuucugcuucaagugcugccgccggacccgcggccuguucaaguaccggcaccugaaggacgacgaggagaccggguaccgccggaucaucgagaagcucaacaacaagaagggcaagaacaagcugcuggacggcgagcgccucgcggacgggcggaucgccgagcuguucagcacgaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17067 - RNA, 3355 nt, Artificial Sequence
  mRNA product Design2 comprising derived and/or modified sequence from CCHVF(10200)__U39455.2__IgE-leader_Gn-4aa-Gc (opt1)
ggggcgcugccuacggagguggcagccaucuccuucucggcaucaagcuuaccauggacuggaccuggauccuguuccucguggccgccgcgacccgcguccacagcuccgaggagcccagcgacgacugcgugucccggacgcagcugcugcgcaccgagaccgccgagauccacggcgacaacuacgggggcccgggggacaagaucaccaucugcaacggcagcacgaucguggaccagcggcucggguccgagcugggcugcuacaccaucaaccgcguccggagcuucaagcugugcgagaacuccgccaccggcaagaacugcgagaucgacagcgugcccgugaagugccgccagggguacugccuccggaucacccaggagggccgcgggcacgucaagcugucccggggcagcgagguggugcuggacgccugcgacacguccugcgagaucaugauccccaaggggaccggcgacauccucgucgacugcagcggcgggcagcagcacuuccugaaggacaaccugaucgaccucggcugccccaagaucccgcugcuggggaagauggccaucuacaucugccgcauguccaaccaccccaagaccaccauggcguuccucuucugguucagcuucggcuacgugaucacgugcauccugugcaaggccaucuucuaccugcucaucaucgugggcacccuggggcggcgccugaagcaguaccgggagcucaagccccagaccugcaccaucugcgagacgacccccgucaacgccaucgacgccgagaugcacgaccugaacugcuccuacaacaucugcccguacugcgcgagccgccugaccuccgacggccucgcccggcacgugauccagugccccaagcgcaaggagaagguggaggagaccgagcuguaccugaaccucgagcggauccccugggucgugcgcaagcugcugcaggugagcgaguccacgggggucgcccucaagcggagcagcuggcugaucgugcugcucgugcuguucaccgucucccugagccccgugcaguccgccccgaucggccgcaagccccucuuccuggacagcaccgccaaggggaugaagaaccugcucaacuccaccagccuggagacgucccugagcaucgaggcgcccuggggcgccaucaacgugcaguccaccuacaagcccaccgucagcaccgccaacaucgcccucuccuggagcuccguggagcaccggggcaacaagauccuggucagcgggcgcuccgagagcaucaugaagcuggaggagcgcacgggcaucuccugggaccucgggguggaggacgccagcgaguccaagcugcugaccgugagcgucauggaccucagccagauguacuccccgguguucgaguaccugagcggcgaccggcagguggaggaguggcccaaggcgaccugcaccggggacugccccgagcgcugcggcugcacguccagcaccugccugcacaaggaguggccccacucccggaacuggcgcugcaacccgaccuggugcuggggcgucgggaccggcugcacgugcugcgggcuggacgugaaggaccucuucaccgacuacauguucgugaaguggaaggucgaguacaucaagaccgaggccaucgugugcguggagcugaccagccaggagcggcagugcucccugaucgaggccggcacccgcuucaaccucgggcccgucacgaucacccugagcgagccccggaacauccagcagaagcugcccccggagaucaucacccuccacccccgcaucgaggagggcuucuucgaccugaugcacgugcagaaggugcuguccgccagcaccgucugcaagcuccaguccugcacgcacggcgugcccggggaccugcagguguaccacaucggcaaccugcucaagggggacaaggucaacggccaccugauccacaagaucgagccccacuucaacaccagcuggauguccugggacggcugcgaccuggacuacuacugcaacaugggggacuggccgagcugcaccuacaccggcgugacgcagcacaaccacgccuccuucgugaaccuccugaacaucgagaccgacuacaccaagaacuuccacuuccacagcaagcgggucaccgcgcacggggacacgccccagcuggaccucaaggcccgccccaccuacggcgccggggagaucaccgugcugguggaggucgccgacauggagcugcacaccaagaagaucgagaucuccggccucaaguucgccagccuggcgugcacgggcugcuacgccugcagcuccagcaucuccugcaaggugcggauccacguggacgagccggacgagcugaccguccacgugaagagcgacgaccccgacguggucgccgccuccagcucccucauggcgcgcaagcuggaguucgggaccgacagcaccuucaaggccuucuccgccaugcccaagacgagccugugcuucuacaucguggagcgggagcacugcaaguccugcagcgaggaggacaccaagaagugcgugaacaccaagcucgagcagccccaguccauccugaucgagcacaagggcaccaucaucgggaagcagaacagcacgugcaccgccaaggccuccugcuggcuggagagcgucaaguccuucuucuacggccucaagaacaugcugagcgggaucuucggcaacguguucaugggcaucuuccuguuccucgcgccguucauccugcugauccucuucuucauguucggguggcgcauccuguucugcuucaagugcugccggcgcacccggggccuguucaaguaccgccaccucaaggacgacgaggagaccggguaccggcgcaucaucgagaagcugaacaacaagaagggcaagaacaagcugcucgacggggagcgccuggccgacggccggaucgccgagcuguucuccacgaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17068 - RNA, 1411 nt, Artificial Sequence
  mRNA product Design2 comprising derived and/or modified sequence from CCHVF(10200)__U39455.2__IgE-leader_Gn (opt1)
ggggcgcugccuacggagguggcagccaucuccuucucggcaucaagcuuaccauggacuggaccuggauccuguuccucguggccgccgcgacccgcguccacagcuccgaggagcccagcgacgacugcgugucccggacgcagcugcugcgcaccgagaccgccgagauccacggcgacaacuacgggggcccgggggacaagaucaccaucugcaacggcagcacgaucguggaccagcggcucggguccgagcugggcugcuacaccaucaaccgcguccggagcuucaagcugugcgagaacuccgccaccggcaagaacugcgagaucgacagcgugcccgugaagugccgccagggguacugccuccggaucacccaggagggccgcgggcacgucaagcugucccggggcagcgagguggugcuggacgccugcgacacguccugcgagaucaugauccccaaggggaccggcgacauccucgucgacugcagcggcgggcagcagcacuuccugaaggacaaccugaucgaccucggcugccccaagaucccgcugcuggggaagauggccaucuacaucugccgcauguccaaccaccccaagaccaccauggcguuccucuucugguucagcuucggcuacgugaucacgugcauccugugcaaggccaucuucuaccugcucaucaucgugggcacccuggggcggcgccugaagcaguaccgggagcucaagccccagaccugcaccaucugcgagacgacccccgucaacgccaucgacgccgagaugcacgaccugaacugcuccuacaacaucugcccguacugcgcgagccgccugaccuccgacggccucgcccggcacgugauccagugccccaagcgcaaggagaagguggaggagaccgagcuguaccugaaccucgagcggauccccugggucgugcgcaagcugcuccaggugagcgaguccacgggggucgcccugaagcggagcagcuggcugaucgugcugcucgugcuguucaccgucucccugagccccgugcaguccgccccgaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17069 - RNA, 2371 nt, Artificial Sequence
  mRNA product Design2 comprising derived and/or modified sequence from CCHVF(10200)__U39455.2__IgE-leader_Gc (opt1)
ggggcgcugccuacggagguggcagccaucuccuucucggcaucaagcuuaccauggacuggaccuggauccuguuccucguggccgccgcgacccgcguccacagcuuccuggacuccacggccaagggcaugaagaaccugcucaacagcaccucccuggagaccagccuguccaucgaggcccccuggggcgccaucaacgugcagagcaccuacaagccgacgguguccaccgccaacaucgcgcucagcugguccagcgucgagcaccgggggaacaagauccugguguccgggcgcagcgaguccaucaugaagcuggaggagcggaccggcaucagcugggaccucgggguggaggacgccuccgagagcaagcugcugaccgucuccgugauggaccucagccagauguacucccccguguucgaguaccugagcggcgaccgccaggucgaggaguggcccaaggccacgugcaccggcgacugccccgagcggugcgggugcaccagcuccacgugccugcacaaggaguggccgcacagccgcaacuggcggugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaccucccaggagcgccagugcagccucaucgaggcgggcacccgguucaaccugggccccgugaccaucacgcuguccgagccccgcaacauccagcagaagcucccgcccgagaucaucacccugcacccccggaucgaggagggguucuucgaccugaugcacgugcagaagguccucagcgccuccaccgugugcaagcugcagagcugcacccacggcgugcccggggaccugcaggucuaccacaucggcaaccuccugaagggcgacaaggugaacgggcaccugauccacaagaucgagccgcacuucaacacguccuggaugagcugggacggcugcgaccucgacuacuacugcaacaugggggacuggcccuccugcaccuacaccggcgugacccagcacaaccacgccagcuucgucaaccugcugaacaucgagacggacuacaccaagaacuuccacuuccacuccaagcgcgugaccgcccacggggacacgccccagcucgaccugaaggcccggcccaccuacggcgcgggcgagaucaccguccugguggagguggccgacauggagcuccacaccaagaagaucgagaucagcgggcugaaguucgccucccuggccugcaccggcugcuacgccugcagcuccagcaucuccugcaagguccgcauccacguggacgagccggacgagcucacggugcacgucaagagcgacgaccccgacgugguggcggccagcuccagccugauggcccggaagcuggaguucgggaccgacuccaccuucaaggccuucagcgccaugcccaagaccucccucugcuucuacaucgucgagcgcgagcacugcaagagcugcuccgaggaggacaccaagaagugcgugaacacgaagcuggagcagccccagagcauccugaucgagcacaagggcaccaucaucgggaagcagaacuccacgugcaccgcgaaggccagcugcuggcucgaguccgucaagagcuucuucuacggccugaagaacaugcuguccggcaucuucgggaacguguucaugggcaucuuccucuuccuggccccguucauccugcugauccucuucuucauguucggguggcggauccuguucugcuucaagugcugccgccggacccgcggccuguucaaguaccggcaccucaaggacgacgaggagaccggguaccgccgcaucaucgagaagcugaacaacaagaagggcaagaacaagcugcucgacggcgagcggcuggccgacgggcgcaucgccgagcuguucagcaccaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17070 - RNA, 1831 nt, Artificial Sequence
  mRNA product Design2 comprising derived and/or modified sequence from CCHFV(10200)__NC_005302.1/U88410.1__N (opt5)
ggggcgcugccuacggagguggcagccaucuccuucucggcaucaagcuuaccauggagaacaagaucgaagugaauaacaaagacgagaugaauagaugguucgaagaguuuaagaaaggcaacgggcuggucgauaccuucacaaauagcuacuccuuuugcgaaucuguucccaaccucgaccgguucguguuucagauggccagcgcuacggaugacgcccaaaaggauuccauuuaugcgucugcucugguggaggccaccaaauucugugccccuaucuacgagugcgcuugggucagcuccacaggaauugugaagaagggccuugaaugguuugagaaaaaugccgggaccaucaagucuugggacgaaagcuauacagagcugaaaguugaugugccgaagauugagcagcucaccggauaccagcaggcugcccugaaauggcgcaaggacaucggcuucagagucaacgcgaauacagccgcucuuuccaacaaggugcuggccgaauauaaaguucccggggagaucgugaugagcgucaaggaaaugcucucugauaugauucggcgcagaaaucugauccugaaccggggaggcgacgagaauccucgcggccccgugucccacgaacacguggauugguguagagaguuugucaaagggaaguacauuauggcuuucaacccucccuggggagacaucaauaaaagcggccggucugggauugcccucguugcgaccggacuggccaaacuugcugagacggaaggcaaagggaucuuugaugaggccaagaagaccguggaagcucugaacggauaucucgacaaacacaaggacgagguggaucgcgccuccgccgacagcaugauuacaaaccugcuuaaacauaucgcuaaggcgcaagaacuguacaaaaauucuuccgcccucagagcucagagcgcccagaucgauaccgccuucuccucuuacuauuggcuguacaaggcuggcgucacaccugagaccuuuccgacggugagccaguuccuguucgagcucggcaagcaaccccgggggacaaagaagaugaaaaaggcccugcuuuccaccccuaugaaauggggaaagaagcuguaugaacucuuugcggacgauagcuuccagcagaaccgcauuuacaugcaccccgcuguucugacagccggcagaaucucugagaugggggugugcuuuggaaccauuccugucgccaaucccgacgaugcugcccagggcuccgggcauaccaaaagcauccuuaaccugcggacaaauacggaaaccaacaauccgugugcuaagacaauugugaaacucuucgagguucaaaagaccggauuuaacauccaggacauggauaucguggccucugaacaucugcugcaccagagccucgucggcaaacaauccccuuuccagaaugcguauaacgugaagggcaaugccacaucugcuaacauuaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17071 - RNA, 1831 nt, Artificial Sequence
  mRNA product Design2 comprising derived and/or modified sequence from CCHFV(Turkey-Kelkit06)__GQ337053.1__N (opt5)
ggggcgcugccuacggagguggcagccaucuccuucucggcaucaagcuuaccauggagaacaagaucgaagugaauagcaaagacgagaugaacaagugguucgaagaguuuaaaaagggcaaugggcugauggauaccuucacaaacuccuacucuuuuugcgaaaauguccccaaccucgacaaauucguuuuucagauggccagcgcuacggaugacgcccaaaaggauuccauuuaugcgucugcucugguggaggccaccaaguucugugccccuaucuacgagugcgcuugggugagcuccacaggaauugucaaaaagggccuugaaugguuugagaaagacucugggaccaucaagagcugggaugaaaauuaugccgagcugaaaguggacguuccgaagauugagcagcucgcuaacuaccagcaggccgcgcugaaguggagaaaagauaucggauuccgggugaaugccaacacagcugcccuuuccaauaagguccuggcugaauauaaagugcccggcgagaucguuaugagcgugaaggaaaugcucucugacaugauucgcagacggaaccugauccugaaucgcgggggagaugagaacccuagaggccccgucucccgggaacacguggaguggugucgcgaguuugugaaaggcaaguacauuauggccuucaauccucccuggggagacaucaacaaaagcgggagaucuggcauugcgcucgucgccaccgggcuggcuaaacuugccgaaacagagggaaagggcguuuuugaugaagcuaagaagaccguggaggcccugaacggguaucucgacaaacaucgggacgaaguggauaaggccuccgcugacagcaugaucacgaaucugccuaaacacauugcgaaggcccaagagcuuuacaagaacucuuccgcucugcgcgcccagggagcccagaucgauaccccguucagcuccuuuuacuggcucuauaaagcuggcgucacacccgagaccuucccuacaaucucucaguuccuguuugaacugggcgagcaacccagagggaccaagaaaaugaagaaagcccuccugagcacgccuaugaaguggggaaagaaacuuuacgaacuguucgcggacgauuccuuucagcagaaucggauuuauaugcaucccgcugugcucacagccggccgcaucagcgagauggggguuugcuucggaaccauuccgguggccaacccugacgaugcugcccagggcucugggcacacaaaguccauccugaaucuuagaaccagcaccgaaacaaacaaucccugugcuaaaacgauugucaagcuguuugagauccaagagaccggauucaacauccaggacauggauauuguggccucugaacaucuccugcaccagagcaucguuggcaaacaauccccuuuucagaaugcguacaacgugaagggcaaugccacaucugcuaacauuaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17072 - RNA, 5437 nt, Artificial Sequence
  mRNA product Design2 comprising derived and/or modified sequence from CCHFV(10200)__U39455.2__GP (opt5)
ggggcgcugccuacggagguggcagccaucuccuucucggcaucaagcuuaccaugcacaucagccugauguacgccauucucugccugcagcuuuguggccugggggagacccauggaucccacaacgaaacaagacauaauaagacggacaccaugacaacccacggcgauaaccccucuagcgagccuccgguguccacagcucucucuaucacccuggaccccagcacagucaccccuacgacccccgccuccgggcuugaaggaucuggcgagguuuauacaagcccucccauuaccacagggucccugccucucagcgaaaccacgccggagcugcccgugacaaccggaacagauacccugucugcgggcgacguggauccuuccacccagacagcuggcgggacgagcgcccccaccguccggacaucucucccuaauucccccagcaccccgucuacaccucaggacacccaucaccccgugcgcaaccugcuuuccguuacgagcccuggacccgaugagacauccacccccucuggcaccgggaaagaaagcuccgccacaagcucuccucacccgguguccaauagacccccuacacccccugcuaccgcccagggacccacggagaacgacagccauaaugcuaccgaacacccggagucucugacacagagcgccaccccuggccucaugacaucccccacccaaaucguccauccucagucugcgacgcccauuaccgugcaggauacacacccuagccccaccaaccgguccaagcgcaaucugaaaauggagaucauccuuacacugagccaggggcucaagaaauacuauggaaagauucugagacugcuccaacugacccuugaagaggacacggaaggccugcucgaguggugcaagcggaaccugggccuugauugugacgauacauucuuucagaaacgcaucgaagaguucuuuauuaccggggagggacacuucaaugaaguucugcaguuuagaacaccgggcacccucucuaccacagaguccacgccugccgggcugcccaccgcugaacccuucaagagcuacuuugccaaaggauuccugucuaucgacuccggcuauuacagcgcuaagugcuauuccgggacaucuaacagcggacuccagcugauuaauaucacccggcauuccacacgcauuguggacaccccuggcccgaaaaucacgaaccuuaagacaaucaauuguauuaaccugaaggccucuaucuuuaaagagcacagagaagucgagauuaacgugcuccugccccaaguggcggucaaucuuagcaacugccauguugugaucaagucccacgugugugauuacagccuggacauugauggcgccguccggcucccucauaucuaccacgaggggguguucauccccggaaccuauaaaauuguuaucgacaagaaaaauaagcugaacgaucgcugcacccuguuuacagacugugugauuaaaggcagagaaguccggaaggggcagucugugcuccgccaguacaagaccgagaucagaauuggaaaggcuuccacaggcuuccggagacugcuuagcgaggaaccuucugaugacugcguuucccgcacgcaacugcuccggaccgaaacagccgagauccacggggauaauuauggcggacccggcgacaagaucaccauuuguaacgggagcacaaucguggaucagagacugggaucugagcugggcugcuacaccauuaaucgcguccggagcuuuaaacuuugcgaaaacuccgcuacggggaagaauugugagaucgacagcgugccugucaaaugcagacagggauauugucuccgcauuacccaggaaggccgggggcaugugaagcugucuagaggcuccgagguugugcuggacgccugcgauacaagcugugagaucaugauucccaagggaaccggcgacauccucgucgauugcuccgggggacaacagcacuuccugaaagacaaccuuaucgaucugggcuguccgaagauuccucuccuggggaaaauggccaucuacauuugccgcaugucuaaucaucccaagacaaccauggcuuuccuguuuugguucagcuuuggauaugugaucacauguauucuuugcaaagcgaucuucuaccuccugaucauuguuggcacccuggggcggagacucaagcaguaccgcgaacugaagccucagacguguacaaucugcgagaccacccccgugaacgccauugacgcugaaaugcacgaucuuaauugcuccuauaacaucuguccguacugcgccucucggcugacaagcgacggccucgccagacacgucauucaauguccuaaacggaaggagaaaguggaagagaccgagcuguaucugaaucuugaacgcauccccugggugguuagaaagcuccugcaggucuccgagucuacgggaguggcucugaaacggagcuccuggcucaucgugcugcuuguccuguuuacagugagccucucuccuguucaguccgcccccauuggccaggggaagaccaucgaagcguacagagcucgcgagggauauacaagcauuugccuguucgugcugggcucuauccuuuuuauugucuccugucucaugaaggggcugguggauagcguuggaaacucuuucuuucccggccuguccaucugcaaaaccuguagcaucuccagcauuaacggguucgaaaucgagucucauaagugcuacuguagccucuuuugcuguccuuauugccggcacugcuccacagacaaagagauucauaagcugcaccuuucuaucuguaaaaagagaaaaaccggcagcaaugugaugcuggccgucugcaagcucauguguuuccgcgccacgauggaaguguccaacagagcucuguuuauucggucuaucauuaauaccacauucguucugugcauccuuauccuggccgugugugucgugagcaccuccgcuguggagauggaaaaccucccggccggaacaugggagcgcgaagaggaucugaccaauuucugccaucaagagugucaggucacggaaacagagugccucugucccuacgaagcgcugguucuuagaaagccucuguuucucgacucuaccgccaaaggcaugaagaaccugcugaauagcacaucccuugagaccagccugucuauugaggcucccuggggagccaucaacgugcaguccaccuacaaaccuacagugagcacggcuaauauugcccucucuugguccagcgucgaacaccggggaaacaagauccugguguccggccgcucugagagcauuaugaaacucgaagagagaaccgggaucuccugggaucugggaguugaagacgcgagcgagucuaaacuucugacaguguccgucauggaccucagccagauguauucucccguguucgaguaccugagcggcgaucggcaaguugaagaguggccuaaggcuaccugcacaggcgacuguccggaacgcugcgggugcaccuccucuacgugucugcacaaagaguggccccauagcagaaauuggcggugcaacccuacaugguguuggggagugggcaccgggugcaccuguugcggacuugaugucaaggaccuguuuacagauuauauguucgugaaauggaagguugaauacaucaaaaccgaggccauugugugugucgagcucacaucccaggaacgccagugcucucugaucgaggccggcacgagauuuaaucucgggcccgugaccauuacacugagcgaaccucggaacauccaacagaaacuucccccggagauuaucacccugcacccuagaaucgaagagggauucuuugaccugaugcaugugcagaagguccucuccgcuagcacaguuuguaaacugcagucuugcacccacggcgugcccggcgaucuucaaguguaucauauugggaaucugcucaagggagacaaagucaacggccaccugauccacaagauugagccccauuucaacacguccuggaugagcugggaugggugugaccucgauuacuauugcaauaugggagacuggccuuccugcaccuacacaggcgugacccagcacaaccaugccucuuuuguuaaucugcuuaacaucgaaacagauuacaccaaaaauuuccacuuucacagcaagcgcgugacagcccauggggacacgccccagcuggaccugaaggcucggccuaccuauggagcgggcgagauuacaguccucguggaaguugccgauauggagcugcacaccaaaaagaucgagauuuccggccuuaaauucgcuucucuggccuguaccgggugcuacgccuguagcuccagcaucucuugcaaggugagaauccaugucgacgaaccggaugagcucacagugcacgucaaauccgacgaucccgacgugguugcugccucuagcucccugauggcgcgcaagcucgaauuuggaacggauagcaccuucaaggcuuucucugccaugccuaagacaagccuguguuuuuauauuguggagcgggaacauugcaaguccuguucugaggaggacaccaaaaagugcgucaacacaaaacuugaacagccccaaagcauccugauugagcacaagggcaccaucauugggaaacaaaauuccacguguacagccaaggcuagcugcuggcuggaauccgugaagucuuucuuuuacggacucaaaaacaugcugagcggcaucuucgggaauguuuuuaugggaaucuuccuuuuucuggccccuuucauucuccugauccucuuuuucauguuuggcuggcgcauucuguucuguuucaagugcugcagacggaccagaggccuuuuuaaauaucgccaccugaaggaugacgaggaaaccggguaccggagaaucauugagaaacugaacaauaagaaggggaaaaacaagcuccuggauggcgagcggcuugcggacgggcgcaucgcugaacuguucuccacaaaaacccauaucggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17073 - RNA, 5437 nt, Artificial Sequence
  mRNA product Design2 comprising derived and/or modified sequence from CCHFV(IbAr10200)__AF467768.2__GP (opt5)
ggggcgcugccuacggagguggcagccaucuccuucucggcaucaagcuuaccaugcacaucagccugauguacgccauucucugccugcagcuuuguggccugggggagacccauggaucccacaacgaaacaagacauaauaagacggacaccaugacaacccccggcgauaacccuucuagcgagccgcccguguccacagcucucucuaucacccuggacccuagcacagucacccccacgaccccugccuccgggcuugaaggaucuggcgagguuuauacaucucccccuauuaccacagggucccugccgcucagcgaaaccacgcccgagcugccugugacaaccggaacagauacccugucugcgggcgacguggaucccuccacccagacagcuggcgggacgagcgccccuaccguccggacaucucuccccaauuccccgagcaccccuucuacaccccaggacacccaccauccugugcgcaaccugcuuuccguuacgagccccggacccgaugagacauccaccccuucuggcaccgggaaagaaagcuccgccacaagcucuccgcaccccguguccaauagaccucccaccccucccgcuacagcccagggaccgacggagaacgacagccacaaugcuaccgaacauccugagucucugacacagagcgccacccccggccucaugacauccccuacccaaaucguccacccccagucugcgacgccuauuaccgugcaggauacacaucccagcccgaccaaccgguccaagcgcaaucugaaaauggagaucauccuuacacugagccaggggcucaagaaauacuauggaaagauucugagacugcuccaacugacccuugaagaggacacggaaggccugcucgaguggugcaagcggaaccugggccuugauugugacgauacauucuuucagaaacgcaucgaagaguucuuuauuaccggggagggacacuucaaugaaguucugcaguuuagaacaccuggcacccucucuaccacagaguccacgcccgccgggcugcccaccgcugaaccuuucaagagcuacuuugccaaaggauuccugucuaucgacuccggcuauuacagcgcuaagugcuauuccgggacaucuaacagcggacuccagcugauuaauaucacccggcacuccacacgcauuguggacaccccgggccccaaaaucacgaaccuuaagacaaucaauuguauuaaccugaaggccucuaucuuuaaagagcauagagaagucgagauuaacgugcuccugccucaaguggcggucaaucuuagcaacugccacguugugaucaagucccaugugugugauuacagccuggacauugauggcgccguccggcucccccacaucuaccaugaggggguguucaucccuggaaccuauaaaauuguuaucgacaagaaaaauaagcugaacgaucgcugcacccuguuuacagacugugugauuaaaggcagagaaguccggaaggggcagucugugcuccgccaguacaagaccgagaucagaauuggaaaggcuuccacaggcagccggagacugcuuucugaggaacccuccgaugacugcaucagccgcacgcaacugcuccggaccgaaacagccgagauccacggggauaauuauggcggaccuggcgacaaaauuaccaucuguaacgggucuacaauuguugaucagagacugggaagcgagcugggcugcuacaccaucaaucgcgugcgguccuucaaacuuugcgaaaacagcgcuacggggaagaauugugagauugacucuguccccgugaaaugcagacagggauauugucuccgcaucacccaggaaggccgggggcacgucaagcuguccagaggcagcgaggugguucuggacgccugcgauacauccugugagauuaugaucccgaagggaaccggcgacauccucguggauugcucugggggacaacagcauuuucugaaagacaaccuuauugaucugggcuguccuaagaucccccuccuggggaaaauggccauuuacaucugccgcaugagcaaucacccuaagacaaccauggcuuuccuguucugguuuuccuucggauaugucauuacauguauccuuugcaaagcgaucuuuuaccuccugauuaucgugggcacccuggggaagcggcucaagcaguacagagaacugaaaccccagacguguacaauuugcgagaccaccccgguuaacgccaucgacgcugaaaugcaugaucuuaauugcucuuauaacauuuguccuuacugcgccagccgccugacauccgacggccucgcccggcacgugauccaaugucccaagagaaaagagaaggucgaagagaccgagcuguaucugaaucuugaacggaucccuuggguggugcgcaaacuccugcagguuucugagagcacgggagucgcucugaagagauccagcuggcucauugugcugcuugugcuguucacagucucucucucccccgugcagagcgcccccaucggccaggggaagaccauugaagcguaccgggcuagagagggauauacaucuaucugccuguuuguucugggcuccauucuuuucaucgugagcugucucaugaaagggcuggucgauucugugggaaacuccuuuuucccuggccugagcaucugcaagaccuguuccauuagcucuaucaacggguuugaaauugagagccacaaaugcuacuguucccucuucugcuguccguauugccgccauugcucuacagacaaggagauccacaaacugcaucuuagcauuuguaagaaacggaagaagggcuccaauguuaugcuggccgugugcaaacucauguguuuuagagccaccauggaagucucuaaccgcgcucuguucaucagaagcauuaucaauacgaccuuugugcugugcauccuuauucuggccguuuguguggucuccacaucugcuguggagauggaaaaccuccccgccggaaccugggagcgggaagaggaucugacaaauuucugccaccaagagugucaggugaccgaaacggagugccucuguccuuacgaagcgcugguccuucgcaagccccuguuccucgacagcacagccaaaggcaugaagaaccugcuuaauuccaccagccuggagacaucucuguccaucgaggcuccuuggggagccauuaacguucagagcaccuacaaacccaccgugucuacagcuaauaucgcccucuccuggagcuccguggaacauagagggaacaagauucuggucucuggccggagcgaguccaucaugaagcucgaggaacgcacggggaucagcugggaucugggaguggaagacgcgucugaguccaaacuucugaccguuagcgugauggaccucucucagauguauagcccugucuuugaguaccuguccggcgauagacaagugggcgaauggccgaaggccacaugcaccggggacugucccgagcggugcggaugcacaucuagcaccugucugcacaaagaauggccucacucccgcaauuggagaugcaaccccacgugguguuggggcguugggacaggaugcaccuguugcggccuugaugugaaggaccuguucaccgauuauauguuugucaaauggaagguggaguacauuaagacagaagcuaucguuuguguggagcucaccucucaggagcggcagugcagccugauugaagccgggacacgcuucaaucucggaccugucacgaucacccuguccgagcccagaaacauucaacagaaacuuccgccugaaaucaucacacugcauccccggauugaggaaggcuuuuucgaccugaugcacgugcagaaggugcucagcgcuucuaccgucuguaaacugcaguccugcacacauggcguucccggggaucuucaaguguaucacaucggaaaucugcucaagggcgacaaagugaacgggcaucugauucacaagaucgagccucacuuuaacaccagcuggauguccugggauggaugugaccucgauuacuauugcaauaugggcgacuggcccucuugcacguacaccggggucacacagcauaaccacgccagcuucgugaaucugcuuaacauugagaccgauuacacaaagaauuuucauuuccacuccaaaagaguuaccgcccacggagacacaccucagcuggaccugaaggcucgcccgacguauggcgcgggcgaaaucaccgugcucgucgagguggccgauauggaacugcauaccaaaaagauugagaucucugggcuuaaauuugcuagccuggccuguacaggaugcuacgccuguuccagcggcaucucuugcaagguucggauucacguggacgagcccgaugaacucaccguccaugugaaauccgacgauccugacgucguggcugccucuagcucccugauggcgagaaagcucgaguucgggacagauagcacguuuaaggcuuucucugccaugcccaaaaccagccuguguuucuauaucguugaacgcgagcacugcaaguccuguucugaagaggacaccaaaaagugcgugaacacaaaacuugagcagccucaaagcauucugaucgaacauaagggaacaauuaucggcaagcaaaauuccaccuguacggccaaagcuagcugcuggcuggaguccgucaagagcuuuuucuacgggcucaaaaacaugcugagcggaaucuuuggcaauguguucaugggcauuuuucuuuuccuggcccccuuuauccuccugauucucuucuuuauguucggguggcggauccuguuuuguuucaagugcugcagacgcacacggggacuuuucaaauauagacaccugaaggaugacgaagagaccggcuaccgccggauuaucgaaaagcugaacaauaaaaaggggaaaaacaagcuccuggauggagagagacuugcggaccggcgcaucgcugagcuguuuuccaccaaaacacacauuggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17074 - RNA, 5449 nt, Artificial Sequence
  mRNA product Design2 comprising derived and/or modified sequence from CCHFV(Turkey-Kelkit06)__GQ337054.1__GP (opt5)
ggggcgcugccuacggagguggcagccaucuccuucucggcaucaagcuuaccaugcccaccaacaucaugcacacaccucuggugugcuucauucucuaccugcagcuucugugucucggcggggcccauggacaacugaaugcuacggagcacaacggcaccaauaacacaaccgccccgggggcgagccagucccccaagccucccaugucuacaaccccuccccaugcuccugaaagcuccacaaucaaaccgaccacgcccauuucugaggccgaaggaagcggcgagaccacauccccucccaauaccacacaggggcuuucuagcccugaaaccacguccgagagacccgccacaaccagcaucucuacauccagcaccgacucuaccaacccgacaacgcagaugaccgauaauacaccuacccccacagucuccaccagcccuucuuccagccccuccacgcccucuacaccucaagggauucaccauccggcucggagccugcucuccguuagcucucccaagaccgugaccacaccuacccccacauccccuggcgagaugagcucugaaacgagcucccagcacucugccaugagccgcauccccaccccgcacacagcuaccagaguguccacagagaucaccaaccaucggacgccucgccagagcgaaucuuccgcccagcaaaccacacccagcccuaugaccucucccgcgcaguccauucugcugaugagcgccgcuccuacagccguccaggacauccaccccuccccgaccaauagaucuaaacggaaccucgagacggagauuauccugacacuuagccagggccugaagaaauauuacgggaagauucucaagcugcuucaucugacccucgaacaagauacagagggacugcuggaauggugcaaaggcaaucucggguccaacugugacgaugacuuuuuccagaagcgcaucgaggaauuuuucaugaccggagagugcuauuuuaaugaggugcugcaguucaaaacccuuucuacacugagcccuacggaacccucccacgcuagacuccccaccgccgagccuuuuaagagcuacuucgcgaaaggcuuucugucuauugauuccggguauuucagcgccaaguguuacccgcggucuuccgcuagcggacuucaacugaucaacguuacacagcaccccgcccgcaucgcugaaaccccuggccccaagacaaccucucucaaaacgauuaauugcaucaaccugagagccagcguguuuaaggagcaucgggaagucgagauuaacgugcugcucccucagaucgccguuaaucuguccaacugucacguggucauuaauagccaugugugcgacuauucucuugauacagacggccccgugcgccugccuagaaucuaccacgaggggaccuucauccccggaaccuacaaaauugucaucgauaagaaaaacaagcucaaugaccgguguacacugguuaccaacugcgugauuaaaggccgcgaagugagaaaggggcaguccguccuucggcaauauaagacagagaucaaaauuggaaaggcuagcacgggcuuuagaaaacugcucuccgaggaaccgggggaugacuguaucucucgcacccagcugcugcggacagaaaccgcggagauccaugacgauaauuacggaggcccuggcgacaagauuacaaucugcaacgggagcaccauuguggaucagagacucggauccgagcugggcugcuauacgaucaaucgcguuaaaucuuucaaacuuuguaagaacagcgccaccgggaagacaugcgaaguggacuccacccccgucaagugucggcagggauucugccugaaaauuacacaagagggcagagggcacgugaagcucucucgcggcagcgaaguugugcuggaugcuugugacuccagcugcgaggucaugaucccuaaaggaaccggcgauauucugguggacuguucugggggacagcagcacuuucuuaaggauaaucucaucgaccugggcugcccccauaucccgcugcucgggcggauggccauuuacaucuguagaauguccaaccacccucgcacaaccauggccuuccuguuuugguucagcuuuggauaugucauuacgugcaucuucuguaaggcucuguuuuacucucugauuaucaucggcacacucgggaaaaagauuaaacaguaucgggagcugaagccccaaaccugcaccaucugcgaaacagccccugugaaugcgauugaugcugagaugcaugaccugaacuguuccuacaauaucugccccuacugugccagcagacuuaccucugacggccucgcccgccacguuacgcagugccccaaacggaaggaaaagguggaggaaacagagcuguaucugaaccucgagcggauuccuuggaucgucagaaaacugcuucagguguccgaaagcaccggaguugcucugaagcgcuccagcuggcucaucgugcugcugguccuucucacagugucucugagcccggugcaguccgcccccguuggccacgggaaaaccauugagaucuaccaaacaagagaaggauucgcuucuauuugucuguuuaugcucggcagcauccuguucauugucuccugccuugugaaggggcugguggauucugucagcgaguccuuuuucccuggacucucuguguguaaaaccugcagcaucggcuccguuaacggguuugaaaucgagagccauaaguguuauugcucucuguucuguugccccuacugccggcacuguuccgccgacagagagauucaucagcugcaccuuagcaucugcaaaaagcgcaagacgggcucuaaugugaugcucgcggucuguaaacggaugugcuucagagccaccauugaggcuucccgcagagcccugcugauccggagcauuaucaacacaaccuuugugauuuguauccucacacugaccaucugcguuguguccacgucugcugucgaaauggaaaaucuuccugccggaacaugggagcgcgaagaggaucugaccaacuucugucaucaggagugccaagugacagaaaccgagugucucugccccuaugaagcgcugguucugagaaagccucuuuuucuggacagcauugugaaaggcaugaagaaucuccugaacuccaccagccucgagacaucucuguccaucgaggccccguggggagcuauuaauguccagagcacguucaaacccaccgugucuacagccaacaucgcucuuagcugguccucugugguccaccggggaaauaagauucugguuaccggccgcagcgaauccaucaugaagcucgaggaaagaacaggggugucuugggaucugggaguggaggacgccagcgaauccaaacugcuuaccgucagcaucauggaucugucucagauguacuccccuguguuugaguaucucagcggcgaccggcagguugaggaauggcccaaggccacguguacaggggauugcccugagcgcugcggcuguaccuccucuaccugccugcacaaagaauggagccauuccagaaacuggcgguguaaucccacauggugcuggggagugggcaccggguguacaugcuguggagucgacgugaaggaucucuucacggaccacauguuuguuaaauggaagguggaguacauuaagaccgaagcuaucgucugcguggcgcugacaucucaagagcgccaguguagccuuauugaggccggcaccagauucaaccuggggccgguuacaaucacccucuccgaaccucggaauauucagcagaaacugccucccgagaucaucacgcugcaucccaagauugaagagggauuuuucgaucuuaugcacgugcaaaaaguccugagcgcuucuaccgugugcaagcuccaguccuguacacauggcauccccggcgaccuucagguguaccacauugggaaccuccugaaaggagacagagucaauggccaccuuauccauaagauugaaagccacuuuaacaccucuuggauguccugggaugggugcgaccuggauuauuacugcaacaugggagacuggccuagcuguacauauaccggcguuacacagcauaaucacgccgccuucgugaaccugcucaauaucgagacggauuacaccaagacauuucacuuccauucuaaacgcgugaccgcucacggggacaccccgcaacuggaucuuaaggcccggcccacauauggagcgggcggcauuacgguccugguggagguugcugacauggaacuccauaccaaaaagguggagaucagcgggcugaaauucgccucccucgccugcacaggauguuacgcuugcucuagcggcaucuccuguaagguccgcauucacguggaugaaccugacgagcugaccguucaugugaaaagcuccgaucccgacgucguggccgcgucuacaagccuuauggcuagaaagcuggaguuugggaccgauuccacguucaaggccuuuucugccaugccuaaaacaagccugugcuucuauaucgucgaacgggaguacuguaaguccugcucugaagacgacacccagaaauguguggauaccagacucgagcagccccaaagcauucugaucgaacacaagggaacaauuaucggcaaacagaacgauaccugcacagcuaaggccuccuguuggcuugagagcguuaaguccuuuuucuacgggcugaaaaauaugcucggaucuguguuuggcaaccuguucaucggcauucuccuguuucuugcuccguucguccugcuggugcucuuuuucauguucggguggaagauccuguuuugcuucaaaugcugucgccggaccagaggacuuuuuaaguaucgccaccugaaagacgacgaggaaacgggcuaccggagaauuaucgagcggcucaauagcaagaaggggaaaaaccgccugcucgauggagacagacuggccgaucggaagauugcggaacuuuucucuacaaaaacccauaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17075 - RNA, 3961 nt, Artificial Sequence
  mRNA product Design2 comprising derived and/or modified sequence from CCHVF(10200)__U39455.2__SP-GP_Gn-NSm-Gc (opt5)
ggggcgcugccuacggagguggcagccaucuccuucucggcaucaagcuuaccaugcacaucagccugauguacgccauucucugccugcagcuuuguggccugggggagacccauggaucccacaacgaaacaucugaggaacccagcgacgauugcguguccagaacgcagcuccugcggaccgagacagcugaaauccauggcgacaauuaugggggaccuggcgauaagauuaccaucuguaacgggucuacaauugucgaccagcgccuuggaagcgagcugggcugcuacaccaucaauagaguucgguccuucaaacucugugagaacucugccacaggcaagaauugcgaaaucgauagcgugccggugaaaugucgccagggguauugccugagaauuacccaggagggacggggccacgucaagcugucccgcgggagcgaagugguucucgacgcgugugauacgucuugcgagaucaugauucccaaaggaaccggcgacauccugguggauuguuccgggggacaacagcauuuucuuaaggacaaccugauugaucucggcugcccuaagaucccccugcuuggcaaaauggcuauuuacaucugcagaaugagcaaucacccuaagacaaccauggccuuccuguuuugguucucuuuuggguaugucaucacauguauucucugcaaagccaucuucuaccugcugauuaucgugggaacccucggccggcgccugaagcaguauagagagcuuaaaccccagacguguacaauuugcgaaaccacaccuguuaacgcuaucgacgccgagaugcacgaucugaauuguuccuacaacaucugcccguacugugcuagccggcucaccucugacgggcuggcccgccaugugauucaaugccccaagagaaaggaaaaagucgaggaaaccgagcuuuaucugaaucucgagcggaucccuuggguggugcgcaagcugcugcaggucuccgaaagcacaggaguugcgcucaaaagauccucuuggcugauugugcuucuggugcucuuuacggucagccugucccccgugcagagcgccccuaucggccaggggaagaccauugaggcuuaccgggccagagaaggauauacaucuaucugucuuuucguucugggcuccauccucuuuauugugagcugccugaugaaaggccuggucgacucuguggggaacagcuucuuucccggacucuccaucuguaagaccugcucuauuagcuccaucaauggcuucgagauugaaagccacaaaugcuacuguucucuguuuugcuguccguauugccgccauuguuccacagauaaggagauccacaagcuccaccugagcauuugcaaaaagcggaaaaccgggucuaacguuaugcucgcuguguguaagcugaugugcuucagagccacgauggaggucuccaaucgcgcgcuguucauccggagcaucauuaacacaaccuuugugcuuuguauccucauucuggccgucugcgugguuuccaccucugcuguggaaauggagaaccugccugccggaacaugggaaagagaggaagaccucaccaauuucugucaucaagagugccaggucacagagacggaaugccugugucccuacgaggcucuugugcugcgcaaaccucucuuucuggauagcaccgccaagggcaugaagaaccugcuuaauuccacaucucucgaaaccagccuguccaucgaggcccccuggggcgcuauuaacguucagagcacauauaaacccaccgugucuacggcgaauaucgcccuguccuggagcucugucgagcaccgggggaacaagauccucguguccggaagaagcgaaucuauuaugaaacuggaggaacgcaccggcaucagcugggaccuugggguggaggaugcuuccgaaagcaagcugcucacaguuucugucauggaccugucccaaauguacagcccuguguucgaguaccuguccggagauagacagguggaggaauggccgaaagcuaccugcacaggcgacugucccgagcggugcggguguaccucuagcacgugccuucauaaggaauggccucacucccgcaauuggcgguguaaccccacauggugcuggggagucggcaccggguguacaugcuguggccucgaugugaaggaccuguuuaccgauuauauguucguuaaauggaagguggaguacauuaaaaccgaagccaucgucugcguggagcugacaucucaggagagacagugcagccucauugaagccggaacgcgguuuaaucugggcccuguuaccaucacacuuuccgagccccgcaacauccaacagaagcugccgccugaaauuaucacccuccaucccagaauugaggaaggguucuuugaccugaugcacgugcagaaaguccugucugccagcacaguguguaaacuucaguccugcacccacggaguuccuggcgaccuccaaguguaucauaucgggaaucugcugaagggagauaaagucaacggccaccucauucauaagaucgagccccacuucaauacgagcuggaugucuugggacgggugugaucuggacuacuauugcaacaugggcgauuggccuuccuguacauacaccggagugacccagcacaaucaugcgagcuuugugaaccuucugaacaucgagacagacuauaccaaaaauuuccacuuucauucuaagcgggucacagcucacggcgauacgccccagcucgaccugaaagccagaccgaccuacggggccggagaaauuacaguucugguggagguggcugauauggaacuucauaccaagaaaaucgagauuuccggccugaaguucgccagccucgcuugcacaggguguuacgccuguucuuccagcaucuccugcaagguccgcauucacguggacgagccugaugaacugaccguucacgugaaaagcgacgaucccgacgucguggcggccucuagcucccucauggcucggaagcuggaguucggaacggacucuaccuuuaaagccuucagcgcuaugcccaagacaucccuuugcuuuuauaucguugaaagagagcauuguaaaucuugcagcgaagaggauaccaagaagugcgugaacacaaaacuggagcagccucaauccauucucaucgaacacaagggcaccaucauugggaaacaaaauucuacauguaccgccaaggcgagcugcuggcuggaguccgucaagagcuucuuuuacggccugaagaacaugcuuucuggaaucuucggcaauguguuuauggggauuuuccuguuucucgccccguucauccugcucauucuguuuuucauguuuggauggcgcauccuuuucuguuucaagugcuguagacggacgcgcggccuguuuaaauauagacaucucaaggacgaugaagagacaggguaccggcgcaucauugaaaaacugaacaauaagaaaggaaagaacaagcugcuugacggcgagagacuggcugauggccggaucgccgagcuuuucuccaccaaaacccacauugggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17076 - RNA, 3934 nt, Artificial Sequence
  mRNA product Design2 comprising derived and/or modified sequence from CCHVF(10200)__U39455.2__IgE-leader_Gn-NSm-Gc (opt5)
ggggcgcugccuacggagguggcagccaucuccuucucggcaucaagcuuaccauggacuggaccuggauccuguuccucguggccgcugccacaagaguccacagcuccgaggaacccucugaugacugcguuagccggacgcagcugcuucgcaccgagacagcggaaauucauggcgauaacuacgggggaccuggcgacaagaucaccauuuguaauggguccacaaucguggaucaaagacugggaucugagcucggcugcuauaccauuaaccgggugcgcagcuuuaaacugugugaaaauuccgcuacagggaagaacugcgagaucgacucugucccggugaaauguagacagggauacugccuucggaucacccaggagggccgcggccacguuaagcugagcagaggguccgaagugguccucgaugccugugacacgagcugcgagauuaugauccccaaaggaaccggcgauauucugguggacuguucugggggacagcaacauuuccugaaggauaaucucaucgaccugggcugcccuaagauuccccuucuggggaaaauggccaucuauauuugucggauguccaaccacccuaagacaaccauggcuuuucucuucugguuuagcuucggauacguuaucacaugcauccugugcaaagccaucuuuuaucuucugauuauugugggcacccucggccgcagacugaagcaguaccgggaacugaaaccccagacguguacaaucugcgagaccacaccugucaaugcuauugaugccgagaugcaugaccucaacuguucuuauaauaucugcccguacugugcgucccgccugaccagcgacgggcuugccagacacgugauccagugccccaagcggaaggaaaaaguggaggaaaccgagcuguaccucaaccuggaacgcauuccuugggucguuagaaagcugcugcaagugucugaguccacaggaguggcucucaaacggagcuccuggcugaucguccugcucgugcuguucacgguuucucuuagccccgugcaguccgccccuauuggccaggggaagaccaucgaggcuuauagagcccgcgaaggauacacaagcauuugucuguuuguccucggcucuauccuguucaucguguccugccuuaugaaagggcugguugauagcgugggaaauucuuucuuucccggccucagcauuuguaagaccugcuccaucucuagcauuaacggcuuugagaucgaaucccacaaauguuauugcagccuguucugcuguccguacugccggcauuguucuacagacaaggagauucacaagcugcaucucuccaucugcaaaaagagaaaaaccgggagcaaugucaugcuggcgguguguaaacuuaugugcuuccgcgccacgauggaagucucuaaccgggcucuguuuauuagauccaucaucaauacaaccuucgugcucuguauucugauccuggccguuugcguggucagcaccuccgcuguggagauggagaaccuuccugccggaacaugggaacgcgaggaagaucucaccaacuuuugucaccaggagugccaaguuacagaaacggagugucugugccccuaugaggcccuggugcuccggaagccucuguuccuugacucuaccgcuaagggcaugaagaaucugcucaacagcacaucccuggaaaccucucugagcauugaggcgcccuggggagccaucaauguccaguccacauacaaacccaccgugagcacggcuaacauugcccuuucuugguccagcguggaacacagagggaauaagauccucguuucuggccgcuccgagagcaucaugaaacuggaggaacggaccgggauuucuugggaucugggcgucgaggacgccagcgaauccaagcuccugacagugagcgugauggaucuuucucagauguauuccccugucuuugaguaccugagcggagacagacaaguggaagaguggccgaaagcuaccugcacaggcgauugucccgagcgcugcggguguaccuccucuacgugccuccauaaggaauggccucacagccggaacuggagauguaaucccacauggugcuggggaguuggcaccggguguacaugcuguggacuggacgugaaggaucuguucaccgacuacauguuugucaaauggaagguggaguauaucaaaaccgaagccauuguuugcguggagcuuacaucccaggaacggcaguguucucucaucgaggcgggcacgcgcuucaaccuggggccugucaccauuacacugagcgagcccagaaauauccagcaaaagcucccgccugaaaucauuacccugcauccccggaucgaggaaggcuuuuucgaccuuaugcacgugcagaaaguucuguccgcuucuacagugugcaagcuccagagcugcacccauggagucccuggcgaucuucagguguaccacauugggaaccugcuuaagggagacaaagugaauggccaccucauccauaagauugagccccacuuuaacacguccuggaugagcugggaugggugugaccuggauuauuacugcaauaugggagacuggccuucuuguacauauaccggcgucacccaacauaaccacgccuccuucguuaaucugcucaacaucgaaacagauuacaccaaaaacuuucacuuccauagcaagagagugacagcccacggggacacgccccagcuggaucuuaaagcucgcccgaccuauggcgccggagagaucacagugcuggucgagguggcugacauggaacuccauaccaagaaaauugagaucucuggccugaaguucgccucccuggcgugcacaggguguuacgccugcucuagcuccauuagcuguaagguucggauccacguggaugaaccugacgagcuuaccguccaugugaaauccgaugaccccgacguuguggcugccagcucuagccugauggcuagaaagcucgaguuuggaacggauuccaccuucaaagccuuuucugcgaugcccaagacaagccugugcuucuacauugucgaacgcgagcacuguaaauccugcucugaagaggacaccaagaagugugugaauacaaaacucgaacagccucagagcauccugauugagcacaagggcaccaucaucgggaaacaaaacuccacaugcaccgccaaggcuucuugcuggcuugagagcguuaaauccuuuuucuauggacugaagaauaugcucagcggcauuuuugggaacguguucaugggcaucuuucuguuccuggccccguuuauucuucugauccucuucuuuauguucggauggcggauucuguucuguuuuaagugcuguagacgcacgagaggccucuucaaauaccggcaucugaaggaugacgaagagacaggguaucgcagaaucaucgaaaaacuuaauaacaagaaaggaaagaauaagcugcucgauggcgagcggcuggcugacgggcgcauugccgaacuguuuucuaccaaaacccacaucggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17077 - RNA, 3355 nt, Artificial Sequence
  mRNA product Design2 comprising derived and/or modified sequence from CCHVF(10200)__U39455.2__IgE-leader_Gn-4aa-Gc (opt5)
ggggcgcugccuacggagguggcagccaucuccuucucggcaucaagcuuaccauggacuggaccuggauccuguuccucguggccgcugccacaagaguccacagcuccgaggaacccucugaugacugcguuagccggacgcagcugcuucgcaccgagacagcggaaauucauggcgauaacuacgggggaccuggcgacaagaucaccauuuguaauggguccacaaucguggaucaaagacugggaucugagcucggcugcuauaccauuaaccgggugcgcagcuuuaaacugugugaaaauuccgcuacagggaagaacugcgagaucgacucugucccggugaaauguagacagggauacugccuucggaucacccaggagggccgcggccacguuaagcugagcagaggguccgaagugguccucgaugccugugacacgagcugcgagauuaugauccccaaaggaaccggcgauauucugguggacuguucugggggacagcaacauuuccugaaggauaaucucaucgaccugggcugcccuaagauuccccuucuggggaaaauggccaucuauauuugucggauguccaaccacccuaagacaaccauggcuuuucucuucugguuuagcuucggauacguuaucacaugcauccugugcaaagccaucuuuuaucuucugauuauugugggcacccucggccgcagacugaagcaguaccgggaacugaaaccccagacguguacaaucugcgagaccacaccugucaaugcuauugaugccgagaugcaugaccucaacuguucuuauaauaucugcccguacugugcgucccgccugaccagcgacgggcuugccagacacgugauccagugccccaagcggaaggaaaaaguggaggaaaccgagcuguaccucaaccuggaacgcauuccuugggucguuagaaaacuucugcaagugucugaguccacaggaguggcucucaagcggagcuccuggcugaucguccugcucgugcuguucacgguuucucuuagccccgugcaguccgccccuauuggcagaaagccccuguuucucgauagcaccgcuaaagggaugaagaaucugcuuaacucuacaucccuggagaccagccucucuaucgaagccccguggggagcgauuaauguccagagcacauauaaaccuaccguguccacggccaacaucgcucugucuuggagcuccguugagcaccgcggcaauaagauccuggugagcgggcggucugaauccauuaugaagcucgaggaaagaacaggaaucagcugggaccugggcgucgaggaugccucugaguccaaacuucugaccgugagcgucauggaccucucccagauguacucucccguguucgaauaucugagcggcgaucgccaaguugaggaauggccuaaggcuaccuguacaggggacugccccgagcgguguggaugcaccuccucuacaugucugcauaaagaauggccccacagcagaaacuggcgcugcaacccuacguggugcuggggcguggggaccggauguacaugcuguggccuugaugucaaggaccucuuuaccgauuacauguucgugaaauggaagguugaguauauuaagacagaggccaucgugugcgucgaacugaccucccaggagcggcaguguagccugauugaagccgggacgagauuuaaucucggcccggugaccaucacacugucugagccccgcaacauucaacagaaacuuccucccgagaucaucacccugcauccucggauugaagagggauucuucgaccucaugcacgugcagaagguucuguccgcuagcacagucugcaaacugcagucuuguacccacggcgugcccggggaucuucaaguguaccauaucggaaaucuccugaagggcgacaaagucaacgggcaccugauucauaagaucgaaccgcacuuuaauacguccuggaugagcugggacggaugcgaucucgacuauuacuguaacaugggcgauuggccuucuugcacauacaccggggugacacagcauaaucacgcgagcuucguuaaccugcuuaauauugagaccgacuauaccaagaacuuucacuuccauuccaaaagagugacagcccacggcgauacgccccagcuggaccucaaggcucgcccuaccuacggagccggcgaaaucacaguccugguggagguugccgauauggagcugcauaccaaaaagaucgaaauuagcgggcuuaaauuugcuucucucgccuguacaggaugcuaugcgugcuccagcuccaucucuuguaaggugcggauucacgucgacgagcccgaugaacugaccgugcacguuaagagcgacgauccugacguggucgcugccuccucuagccugauggccagaaaacucgaguucggcacggauuccacauuuaaggcuuucucugccaugcccaaaaccagccugugcuuuuacaucguggaacgggagcauuguaaguccugcagcgaggaagacaccaaaaagugugugaauacaaaacuugagcagccgcaaucuauucugaucgaacacaaggggaccaucauuggaaagcagaacuccacaugcacggcuaaagccagcuguuggcucgagucugucaaguccuucuuuuauggccugaaaaauaugcugagcgggaucuucggcaacguuuuuaugggaauuuuccuuuuccucgcgccuuuuauccugcugauucucuucuuuauguucggcuggcgcauccuguuuugcuucaaguguugcagacggaccagagggcuuuuuaaauaccgccaucugaaggacgaugaagagacaggauaucggagaaucauugagaagcucaauaacaaaaagggcaaaaacaagcugcuggacggggaacgccuugccgauggaagaaucgcugagcuguucucuaccaaaacacacauuggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17078 - RNA, 1411 nt, Artificial Sequence
  mRNA product Design2 comprising derived and/or modified sequence from CCHVF(10200)__U39455.2__IgE-leader_Gn (opt5)
ggggcgcugccuacggagguggcagccaucuccuucucggcaucaagcuuaccauggacuggaccuggauccuguuccucguggccgcugccacaagaguccacagcuccgaggaacccucugaugacugcguuagccggacgcagcugcuucgcaccgagacagcggaaauucauggcgauaacuacgggggaccuggcgacaagaucaccauuuguaauggguccacaaucguggaucaaagacugggaucugagcucggcugcuauaccauuaaccgggugcgcagcuuuaaacugugugaaaauuccgcuacagggaagaacugcgagaucgacucugucccggugaaauguagacagggauacugccuucggaucacccaggagggccgcggccacguuaagcugagcagaggguccgaagugguccucgaugccugugacacgagcugcgagauuaugauccccaaaggaaccggcgauauucugguggacuguucugggggacagcaacauuuccugaaggauaaucucaucgaccugggcugcccuaagauuccccuucuggggaaaauggccaucuauauuugucggauguccaaccacccuaagacaaccauggcuuuucucuucugguuuagcuucggauacguuaucacaugcauccugugcaaagccaucuuuuaucuucugauuauugugggcacccucggccgcagacugaagcaguaccgggaacugaaaccccagacguguacaaucugcgagaccacaccugucaaugcuauugaugccgagaugcaugaccucaacuguucuuauaauaucugcccguacugugcgucccgccugaccagcgacgggcuugccagacacgugauccagugccccaagcggaaggaaaaaguggaggaaaccgagcuguaccucaaccuggaacgcauuccuugggucguuagaaaacuucugcaagugucugaguccacaggaguggcucucaagcggagcuccuggcugaucguccugcucgugcuguucacgguuucucuuagccccgugcaguccgccccuauuggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17079 - RNA, 2371 nt, Artificial Sequence
  mRNA product Design2 comprising derived and/or modified sequence from CCHVF(10200)__U39455.2__IgE-leader_Gc (opt5)
ggggcgcugccuacggagguggcagccaucuccuucucggcaucaagcuuaccauggacuggaccuggauccuguuccucguggccgcugccacaagaguccacagcuuucuggauuccacggcgaagggcaugaaaaaccuucucaauucuaccagccuggagacaucccugucuauugaagcucccuggggagccaucaacguucagagcaccuacaagccuacaguguccaccgccaauauugcucuuucuuggagcuccguggagcaucgggggaacaaaauccuggucagcggccgcucugaauccauuaugaagcucgaggaaagaacagggaucagcugggaccugggaguggaggaugccucugaguccaaacugcucaccguuagcgugauggaccugucucaaauguauuccccggucuucgaauaccuuagcggcgaucgccagguggaggaauggcccaaggcuacgugcaccggggacuguccugagcggugcggauguacauccucuaccugccugcacaaggaguggccccauagcagaaauuggcgguguaacccuacauggugcuggggcguuggcaccggguguacgugcuguggacucgaugugaaagaccuguuuacagauuauauguucgucaaguggaaaguggaauacaucaagaccgaggccauugugugcgucgaacuuacaucccaggagcgccaguguagccugaucgaagcgggcaccagauuuaaucucgggcccguuaccauuacacugucugagccucggaacauccaacagaaacugccgcccgagauuaucacgcuccacccucgcauugaagagggauucuuugaccugaugcaugugcagaaggugcuuuccgccagcaccgucugcaagcugcagucuugcacacacggcgugcccggggaucuccaaguuuaucacaucggaaaucugcuuaaaggcgacaaggugaacggccaucugauccacaaaauugaaccucauuucaauaccagcuggauguccugggaugggugugaccucgacuacuauugcaacaugggagauuggcccucuuguacauacaccggcgucacgcagcacaaucacgcuagcuuugugaaccugcugaauaucgagacagacuacaccaagaacuuccauuuucacuccaaaagaguuaccgcccauggggauacaccgcagcucgaccugaaggcucggccuaccuauggagccggcgaaauuacagugcuugucgagguggcggauauggagcugcacacgaaaaagaucgaaauuagcgggcucaaguucgccucucuggcuugcaccggauguuacgccugcuccagcucuaucuccuguaaaguccgcauccauguggacgagcccgaugaacuuacaguucacgugaaguccgacgauccugacgucguggcugccuccucuagccugauggccagaaaacucgaguuuggcaccgauuccacauucaaggcuuucucugcgaugcccaaaaccagccugugcuuuuauauuguugaacgggagcacuguaaguccugcagcgaggaagacacgaagaaaugugugaacaccaagcuggagcagccccaaucuauccucauugaacauaaaggcacaaucauugggaagcagaauagcacaugcaccgccaaagcuagcugcuggcuggagucugucaaguccuucuuuuacggacuuaagaacaugcugagcggcaucuucgggaauguguuuaugggaaucuuccucuuucuggccccuuucauucugcuuauccucuuuuucauguuuggcuggcgcauucuguucuguuuuaaaugcuguagacggaccagagggcuguucaaguaucgccaccucaaagacgaugaggaaacgggcuaccggagaaucauugagaagcugaacaauaaaaagggaaagaacaaacuucuggacggcgaacgccucgccgaugggcggaucgcugagcuguucucuacaaagacccauauuggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17080 - RNA, 1831 nt, Artificial Sequence
  mRNA product Design2 comprising derived and/or modified sequence from CCHFV(10200)__NC_005302.1/U88410.1__N (opt11)
ggggcgcugccuacggagguggcagccaucuccuucucggcaucaagcuuaccauggaaaacaaaaucgaggugaacaacaaagacgaaaugaaccgaugguucgaagaguucaagaaaggcaacggacuuguagacacguucaccaacuccuacuccuucugcgaaucaguccccaaccuagaccgauucgucuuccaaauggccagcgcaacagacgacgcacaaaaagacucgauauacgcauccgcccuaguagaagcaaccaaauucugcgcccccaucuacgaaugcgcuuggguaucuagcacaggaaucgucaagaaaggacucgaaugguucgagaaaaacgccggcacaaucaaauccugggacgaaucauacaccgaacuaaaaguagacguacccaaaauagaacaacucaccggcuaccaacaagccgcacuaaaauggcggaaagacaucggcuuccgcgucaacgccaacaccgccgcccucuccaacaaaguccuagccgaauacaaaguccccggcgaaaucgucauguccgucaaagaaaugcucuccgacaugaucagacggcgcaaccucauccuuaaccgcgggggagacgaaaauccccgcggacccgucucucacgaacacgucgacuggugccgcgaguucgucaaaggcaaauacauaauggcguucaacccacccuggggagacauaaacaaaucaggccggucaggcaucgcccucgucgccaccggacuagccaaacucgcagaaacggaaggcaagggcauauucgacgaagcuaagaaaaccgucgaggcacuuaacggauaccuagacaaacacaaagacgaggucgaccgagccagcgcagacagcaugauaaccaaccuacugaaacacaucgcaaaagcgcaagaacuauacaaaaacuccucagcccuccgagcccaaagcgcacaaaucgacacagcauucuccaguuacuacuggcucuacaaagcaggagucacccccgaaacauuccccacagucagccaauuccucuucgaacuaggaaaacaaccccgaggcacaaagaaaaugaagaaagcguuacucagcacccccaugaaauggggcaagaaacuauacgaacucuucgccgacgacuccuuccaacaaaaccgcauauacaugcacccggccguacuuaccgcaggacgcauaucagagaugggcgucugcuucgguaccauccccguggccaacccagacgacgcagcacaaggaucuggccacaccaaaagcauccucaaccuccgcacaaacaccgaaaccaacaacccaugcgcaaaaacaauagucaaacuauucgaaguccaaaagaccggcuucaacauccaagacauggacaucgucgcaucugaacaccuacuccaccaaagccuggucggaaaacaaucccccuuccaaaacgccuacaaugucaaaggcaacgcaaccuccgccaacaucaucuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17081 - RNA, 1831 nt, Artificial Sequence
  mRNA product Design2 comprising derived and/or modified sequence from CCHFV(Turkey-Kelkit06)__GQ337053.1__N (opt11)
ggggcgcugccuacggagguggcagccaucuccuucucggcaucaagcuuaccauggaaaacaaaauagaagucaacuccaaagacgaaaugaacaaaugguucgaagaauuuaaaaaaggcaacggccuaauggacacauucaccaacucuuacuccuucugcgaaaacguccccaaccucgacaaauucgucuuccaaauggccuccgccaccgacgacgcccaaaaagacucaaucuacgccuccgcccuagucgaagccacgaaauucugcgccccaaucuacgaaugcgccuggguaagcuccaccggcauagugaaaaagggcuuagaaugguucgagaaagacuccggaaccauaaaaucaugggacgaaaacuacgcagaacucaaaguagacguacccaaaaucgagcaacucgccaacuaucagcaagcagcccuaaaauggcgcaaagacauagguuuccgcguaaacgccaacaccgccgcccucucaaacaaaguccucgccgaauacaaagucccgggagaaaucgugaugucagucaaagaaaugcuaagcgacaugauccgccgccgcaaucuaauccucaaccgcgguggagacgaaaacccccgagggcccgucagccgagaacacgucgaauggugcagagaauuuguaaaaggcaaauacauuauggcauuuaacccaccauggggcgacaucaacaagucaggacgaaguggaaucgcacucgucgccacaggccucgccaaacucgcagaaaccgaaggaaaaggcgucuucgacgaagcaaaaaaaaccgucgaggcccuuaacggauaccucgacaaacaccgcgacgaagucgacaaagccuccgcggacuccaugauaacaaaccucccaaaacacaucgcgaaagcccaagaacucuacaaaaacuccucagcacucagagcccaaggagcccaaauugacaccccguucuccagcuucuacuggcuuuacaaagcaggcgucacccccgaaacauuccccaccaucagccaguuccuauucgaacucggagaacaaccaagaggaacaaaaaaaaugaaaaaggcccuccucuccacacccaugaaauggggaaaaaaacuguacgaacucuucgccgaugacucauuccaacaaaaccgcaucuacaugcacccugccguccucaccgccggccgcauaagcgaaaugggggucugcuucggcaccauacccgucgccaauccagacgaugcagcccaaggcuccggacauaccaaaagcauccugaaccuccgaaccagcacagaaaccaacaaccccugcgccaagacaaucgucaagcuauuugaaauccaagaaaccggcuucaacauacaggacauggacaucgucgccucggaacaccuccuccaccaauccaucgucggaaaacaaagucccuuccagaacgcauacaacgucaaaggcaacgccacauccgccaacaucaucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17082 - RNA, 5437 nt, Artificial Sequence
  mRNA product Design2 comprising derived and/or modified sequence from CCHFV(10200)__U39455.2__GP (opt11)
ggggcgcugccuacggagguggcagccaucuccuucucggcaucaagcuuaccaugcacaucagccugauguacgccaucuuaugccuacagcugugcggccucggggaaacccacggcucccacaacgagacccgccacaacaagacggacaccaugaccacccacggggacaaccccagcuccgagccgcccgugagcacggcccuguccaucacccuggaccccagcaccgucacccccacgaccccggcguccggccucgaggggagcggcgagguguacaccuccccgcccaucaccacgggcagccugccccuguccgagaccacccccgagcuccccgugaccacggggaccgacacccugagcgccggcgaugucgaccccuccacccagacggccgggggcaccagcgcccccaccgugcggacgucccugccgaacagccccucgacgcccagcacgccccaggacacccaccacccggugcgcaaccuccuguccgucaccagccccgggcccgacgagaccagcaccccguccggcaccggcaaggagagcuccgccaccagcuccccgcacccagugagcaaccggccucccacgccacccgcgaccgcccaggggcccaccgagaacgacucccacaacgccaccgagcaccccgagagccugacgcaguccgccacccccggccucaugaccagccccacccagaucgugcacccccaguccgcgaccccgaucacgguccaggacacccaccccagccccaccaaccgcuccaagcggaaccugaagauggagaucauccugacccucagccaggggcugaagaaguacuacggcaagauccugcgccuccugcagcuaacgcucgaggaggacacggagggccugcucgaauggugcaagcggaaccucgggcuggacugcgacgacaccuucuuccagaagcggaucgaggaguucuucaucaccggcgaggggcacuucaacgaggugcugcaguuccggacgcccggcacccucuccacuaccgagagcacgccggccgggcugcccaccgccgagcccuucaaauccuacuucgccaaggguuuccugagcaucgacuccggcuacuacagcgccaagugcuacagcgggaccuccaacagcggccuccagcugaucaacaucacccgccacuccacucggaucguagacacccccgggccgaagaucacgaaccugaagaccaucaacugcaucaaccucaaggcgagcaucuucaaggagcaccgagagguggagaucaacgugcugcugccccagguggccgucaaccucuccaacugccacguggugaucaagagccacgugugcgacuacucccuggacaucgacggcgccgugcggcugccccacaucuaccacgaggggguguucauccccggcacguacaagaucgucaucgacaagaagaacaagcucaacgaccgcuguacccuuuucaccgacugcgugaucaagggacgggaggugcgcaagggccagagcguccugcggcaguacaagacugagauccgcaucggcaaggccuccaccggguuccggcgccuccugagcgaggaaccguccgacgacugcgugagccggacccagcuguuacgcacagagaccgccgagauccacggcgacaacuacgggggccccggcgacaagaucacgaucugcaacggguccaccaucgucgaccagcgccugggcagugaacuggggugcuacaccaucaaccgggugcgcuccuucaaacugugcgagaacagcgcgaccggcaagaacugcgagaucgacuccgugcccgucaagugccggcagggcuacugccuccgcaucacgcaggaggggcguggccacgugaagcugagccgcgggagcgaggugguccuggacgccugcgacaccuccugcgagauaaugauccccaagggcaccggggacauccuaguggacugcagcgggggccagcagcacuuccugaaggacaaccugaucgaccucgggugcccgaagaucccccugcugggcaagauggccaucuacauuugccggauguccaaccaccccaagaccacgauggccuuccucuucugguucagcuucggguacgugaucacgugcauccugugcaaggcuaucuucuaccugcucaucaucgucggcacccuggggcgccggcugaagcaguaccgugagcucaagccccaaaccugcaccaucugcgagaccaccccgguaaacgcgaucgacgccgagaugcacgaccugaauugcuccuacaacaucugccccuacugcgccucccggcugaccuccgacggccucgcccgccacgugauccagugccccaagcggaaggagaaggucgaggagaccgagcuguaccugaaccucgagcgcauccccuggguggugcggaagcugcugcaggucagcgaguccacgggcguggcccucaagcgcagcuccuggcugaucgugcugcucguccuguuuaccgugagccuguccccggugcagagcgcgcccaucgggcagggcaagaccaucgaggccuaccgggcccgcgagggguacaccuccaucugccucuucguccugggcagcauccuguucaucguguccugccucaugaagggucugguggacagcgucgguaacuccuucuuccccggccugagcaucugcaagacgugcagcaucuccagcaucaacggguucgagaucgagucccacaagugcuacugcagccucuucugcugcccguacugucggcacugcuccaccgacaaggagauccacaaacugcaccugagcaucugcaagaagcgcaagaccggcuccaacgugaugcucgcugugugcaaacugaugugcuuccgcgcgaccauggagguaagcaaccgggcccuguucauccgcuccaucaucaacacgaccuucgugcucugcauccuuauccuggccgugugcgucgugagcaccuccgccguugagauggagaaccuccccgccgggaccugggagcgggaggaggaccugacgaacuucugccaccaggagugccaagucaccgagaccgagugccugugccccuacgaggcgcucgugcugcgcaagccccuguuccucgacagcaccgccaagggcaugaagaaccugcugaacuccacgagccucgagaccucccugagcaucgaggccccguggggcgccaucaacgugcaguccaccuacaagcccaccgucagcacggccaacaucgcgcugucauggagcagcguggagcaccggggaaacaaaauccucguguccggccgcagcgaguccaucaugaagcuggaggagcggaccgguaucagcugggaccuuggagucgaggacgccuccgagagcaagcuccugaccguguccgugauggaccuaagccaaauguacucccccgucuucgaguaccucagcggggaccgccagguggaagaauggcccaaggcgaccugcacgggcgacugcccggagcggugcggcugcaccuccagcacgugccugcacaaggaguggccccacucccgcaacuggaggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccaaugcucccugaucgaggccgggacccgguucaaccucggccccgugaccaucacccugagcgagccgcgcaacauccagcagaagcugccgcccgagaucaucacccuccacccccggaucgaggagggcuucuucgaccugaugcacguccagaaggugcuguccgccagcacggugugcaagcuccaguccugcacccacggggugcccggcgaccuccagguguaccacaucgggaaccugcugaagggcgacaaggucaacgggcaccugauccacaagauugagccccacuucaacacuagcuggaugagcugggacggcugcgaucuggacuacuauugcaacaugggcgacuggcccuccugcaccuacacaggggugacccagcacaaccacgccagcuucgugaaccuccugaacaucgagaccgacuacaccaagaacuuccacuuccacuccaagcgcgucacggcccacggcgacacgccccagcuugaccucaaggcccggccgaccuacggggcgggcgagaucaccgugcugguggagguagccgacauggagcugcacaccaagaagaucgagaucagcgggcucaaguucgccucccuggccuguaccggcugcuacgccugcagcuccagcaucuccugcaaagugcgcauccacguggacgagcccgacgagcuaaccguccacgucaagagcgacgaccccgaugugguggcggccucgucuuccuuaauggcccggaagcuggaguucggcaccgacucgacguucaaggccuucuccgccaugcccaagaccagccugugcuucuacaucguggagcgcgagcacugcaaguccugcagcgaggaagacaccaagaaaugcgugaacaccaagcucgagcagccgcaauccauccugaucgagcacaaggggacgaucaucggcaagcagaacuccacgugcaccgcgaaagccagcugcuggcuggaaagcgucaagagcuucuucuacgggcugaagaacaugcucuccggcauuuucggcaacguguucauggggaucuuucuguuccuggcccccuucauccuccugauccuguucuucauguucggcuggcggauccucuucugcuucaagugcugccgccgcacccgggggcuguucaaguaccgccaccugaaagacgacgaggagaccggcuaccggcgcauuaucgaaaagcucaacaacaagaaggggaagaacaagcugcuggacggugagcggcucgccgacggccgcauugccgagcuguucagcaccaagacccacaucggguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17083 - RNA, 5437 nt, Artificial Sequence
  mRNA product Design2 comprising derived and/or modified sequence from CCHFV(IbAr10200)__AF467768.2__GP (opt11)
ggggcgcugccuacggagguggcagccaucuccuucucggcaucaagcuuaccaugcacaucagccugauguacgccauccucugccugcagcugugcggccucggggagacccacggcucccacaacgagacccgccauaacaaaaccgacaccaugacgacgcccggggacaacccgagcuccgagccgcccgucagcaccgcccugucgaucacccuggaccccagcacugucacgccgacgacccccgcguccggccucgaggggagcggagagguauacaccucaccgcccauaaccacgggcagccugccccuguccgagaccacccccgagcuccccgugaccacgggaaccgacacccucagcgccggcgacgucgaccccuccacccagacggccgggggcaccagcgccccgaccgugcggaccagccugccuaacucucccuccacgcccagcacgccgcaggacacccaccaccccgugcgcaaccuccuguccgucaccagccccgggcccgacgagacgagcaccccguccggcaccgggaaggaaagcuccgccacaagcagcccccaccccgugagcaaccggcccccgaccccgcccgcgaccgcccagggucccacagagaacgacucccacaacgccaccgagcacccggagagccugacucaguccgccacccccggccucaugaccagccccacccagaucgugcacccgcaguccgcgacccccaucacgguccaggauacucaccccagucccacgaaccgcuccaagcgaaaccugaagauggagaucauccugacccucagccaggggcugaagaaguacuacggcaagauccugcgccuccugcagcugacgcuagaggaggacaccgagggucugcuggaguggugcaagcggaaccucgggcuggacugcgaugacaccuucuuccagaagcgcaucgaggaguucuucaucaccggcgaggggcacuucaacgaggugcugcaguuccgaacgccgggaacccucuccaccacagagagcacgcccgccgggcugcccacggccgagcccuucaaguccuacuucgccaagggcuuccugagcaucgacuccgguuacuacagcgccaagugcuacagcgggacguccaacagcggccuccagcuuaucaacaucacccgccacuccacgcggaucgucgacaccccggggcccaagaucaccaaccugaagaccaucaacugcauaaaccucaaggcgagcaucuucaaggagcaccgcgaggucgagaucaacgugcugcugccccagguggccguaaaccucuccaacugccacguagugauaaagucacacgucugugacuacagucuggacaucgacggcgccgugcggcugccccacaucuaccacgaggggguguucaucccuggcacguacaagaucgucaucgacaagaagaacaaacucaacgaccgcugcaccuuauucacagacugcgugauaaagggccgggagguucgcaaggggcaaagcguccugcggcaguacaagaccgagauccgcaucgggaaggccuccacggggagccggcggcuccuguccgaggagcccagcgacgacugcauuucccggacccagcugcuccgcaccgaaaccgccgagauccacggcgacaacuacgggggccccggcgacaagaucacgauuugcaacggcagcaccaucguggaccagcgccugggcuccgagcuagggugcuacacgaucaaccguguccgcagcuucaagcugugcgagaacucggcuaccggcaagaacugcgagauugacucagugcccgugaagugccggcagggcuacugccuccguaucacucaggaggggcggggccacgugaagcugagccgcggguccgagguggugcucgacgccugcgacaccagcugcgagaucaugaucccuaagggcaccggggacauccucgucgacugcuccggcggccagcagcacuuccucaaggacaaccugaucgaucucggguguccuaagaucccccugcugggcaagauggccaucuacaucugccggaugagcaaccaccccaagaccacgauggcauuccucuucugguucuccuucggguaugugaucaccuguauccucugcaaggcuaucuucuaccuccuuaucaucguuggcacccuggggaagcgccugaagcaguaccgggagcucaagccgcagaccugcaccaucugcgagacgacccccgucaacgcgaucgacgccgagaugcacgaccugaacugcagcuacaacaucugccccuacugcgccucccgucugaccagcgacgggcucgcccggcacgugauucagugccccaagcgcaaagaaaagguggaggagaccgagcuguacuuaaaccucgaacggaucccgugggucgugcgcaagcugcugcagguauccgagagcacgggcgucgcccucaagcgguccagcuggcugaucguacugcucgugcuguucaccgucucccugagccccguacaguccgcgcccaucgggcagggcaagaccauagaagcguaccgcgcccgggagggguacacuucuauuugccucuucgugcugggcuccauccuguucaucgucaguugucucaugaaggggcucguggacucagugggcaacagcuucuucccgggccugagcaucugcaagacgugcucgaucagcuccaucaauggguucgagaucgagagccacaagugcuacugcucccucuucugcugccccuacugccgccacugcagcaccgacaaggagauccacaagcugcaccugucuauaugcaagaagcggaagaagggcagcaacgucauguuagccguuugcaagcugaugugcuuccgcgcgaccauggagguguccaaccgcgcccuguucauccggagcaucaucaacacuacguucguccucugcauacugauacuggccguguguguggucuccaccagcgccguggagauggagaaccuccccgccgggaccugggagcgcgaggaagaccugaccaacuuuugccaccaagagugccaagugacggagaccgagugccugugccccuacgaggcgcucguccugcggaagccgcuguuccucgacuccaccgccaagggcaugaagaaccugcugaacagcacaucccucgagacaagccuguccaucgaggcccccuggggcgccaucaacguucagagcacauacaagccgaccguguccaccgcuaacauugcacugagcuggagcuccgucgagcaccgcgggaacaagauccucgugagcggccgauccgagagcaucaugaagcuggaggagcgcacggggaucuccugggaccugggcguggaggacgccagcgaguccaagcuccugaccgucagcgucauggaccugucucagauguacagcccgguguucgaguaccucaguggggaccggcaggucggagaguggccgaaggcaaccugcaccggcgacugccccgagcgcugcgggugcacgagcucgacuugccugcacaaggaguggccccauagccggaacuggcgcugcaaccccaccuggugcuggggcguggggaccggcugcacgugcugcgggcuggacgucaaagaccucuuuaccgacuacauguucguaaaguggaagguggaguauaucaagaccgaggccaucgugugcgucgagcugaccagucaggaacggcaguguagccugaucgaggccggcacgcgauucaaccucggcccggugaccauaacccuguccgagccccggaacauccagcagaagcugcccccggagaucaucacccuccacccgcgcaucgaagaaggguucuucgaccugaugcacguccagaagguacugagcgccaguacagugugcaagcuccaguccugcacgcauggcgucccaggggaccuccagguguaccacaucggcaaucugcugaaaggggauaaggugaacggccaccugauccacaaaauagagccccacuucaacaccagcuggauguccugggacggcugugaccuggacuacuacugcaacaugggggacuggcccagcugcaccuacaccggcgucacgcagcacaaccacgccuccuucgucaaccuccugaacaucgagaccgacuacaccaagaacuuccacuuccacagcaagcgugugaccgcccacggggacacgccgcaguuagaccucaaagcccgccccacguacggcgcgggggagaucaccguacugguugagguggccgauauggagcugcacacuaagaagauugaaaucuccggccucaaguucgccucgcuggccugcacgggcugcuacgccugcuccucagggaucuccugcaagguccggauccacguagacgagcccgacgagcugacagugcacgucaagagcgacgaccccgacgugguggcggccuccagcucccucauggcccgcaagcuggaguucggcaccgacagcaccuuuaaggccuucuccgccaugccgaagacgagccugugcuucuacaucgucgagcgggagcacugcaaauccugcagcgaggaggacaccaagaagugcgugaacaccaaacucgagcagccccaguccauccugaucgagcacaaggggaccaucauaggcaaacagaacagcacgugcaccgcgaaggccagcugcuggcuggaguccgugaaguccuucuucuacggccugaagaacauguuauccgggaucuucggcaacgucuucauggggaucuucuuguuccuggcacccuucauucuccuuauccuguucuucauguucggcuggcgcauccucuucugcuucaagugcugccgccgcacccgcgggcuguucaaguaccggcaccugaaggacgacgaggagaccggauaucgccggaucaucgagaagcucaacaacaagaagggcaagaacaagcugcuggauggcgagcgccucgccgaccggcgcaucgccgaacuguucagcacgaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17084 - RNA, 5449 nt, Artificial Sequence
  mRNA product Design2 comprising derived and/or modified sequence from CCHFV(Turkey-Kelkit06)__GQ337054.1__GP (opt11)
ggggcgcugccuacggagguggcagccaucuccuucucggcaucaagcuuaccaugcccaccaacauuaugcacaccccgcuggugugcuucauccucuaccugcagcuguuaugccugggcggggcccacggccaacugaacgccacggagcacaacgggaccaacaacacaacggcgcccggcgccagccagucccccaaacccccgaugagcacuacaccaccccacgcccccgaguccagcaccaucaagccgaccacgccaauuuccgaggccgaggggagcggagagaccaccuccccgcccaauaccacgcagggccucaguucccccgagaccaccagcgagcgcccugccaccacguccaucagcacuuccagcaccgacuccaccaaccccacgacgcagaugaccgacaacacccccacuccgaccgucucgaccucccccagcuccagccccagcacccccuccacuccgcaggggauccaccacccagcgcggagccugcuguccguuucuucccccaagaccgugaccacccccacgccgaccagccccggugagauguccagcgagaccuccagccagcacagcgccaugagccgcauccccacuccccacaccgcgacccggguauccaccgagaucaccaaccaccgcaccccgcggcagagcgagucaagcgcccagcagacgacgccuucccccaugaccagcccggcgcaguccauccuccugaugagcgccgcacccaccgccgugcaggacauccaccccagcccaacgaaccgcuccaagcggaaccuggaaaccgagaucauccucacccucagccaggggcugaagaaguacuauggcaagauucucaagcuccugcaccucacccuggagcaagacacggaggggcugcucgaauggugcaagggcaaccugggcuccaacugcgacgacgacuucuuccagaagaggaucgaggaguucuucaugaccggggagugcuacuucaacgaggugcugcaguucaagacccucagcacccuguccccgaccgagcccagccaugcccggcugcccaccgcggagcccuucaaguccuacuucgccaagggguuccugagcaucgacuccggguauuucagcgccaaaugcuacccgcgcuccagcgccucaggccugcagcugaucaacgucacccagcaccccgcccggaucgcugagacccccggccccaaaacgacuagccucaagaccaucaacugcaucaaucugcgcgccuccguguucaaggagcacagagagguggaaaucaacgugcugcucccgcagauagccgugaaccugagcaacugccacguggucaucaacucccacgugugcgacuacagccuggacaccgacgggcccgugcgucucccccgcaucuaccacgagggcacguucauccccgggacauacaagaucgucaucgacaagaagaacaagcugaacgaccgcugcacgcuggugacgaacugcgugaucaagggccgggagguccgcaaagggcagagcguguugcgucaguacaagaccgagaucaagaucggcaaggccuccaccggguuccgcaagcugcugagcgaggaaccgggggacgacugcaucucccggacccaacucuugcgcaccgagacggcugagauccacgacgacaacuacggcgggcccggcgacaaaaucaccaucugcaacggcucaacuauuguggaccagagacugggcuccgaguuaggcugcuacaccaucaaccgggucaagagcuuuaagcugugcaagaacuccgcgacggggaagaccugcgaggucgacagcacccccgugaagugccgucagggcuucugucucaagauuacccaggaggggcggggccacgugaagcugucccgcgggucagaggugguacuggacgccugcgacuccagcugcgaggugaugauccccaagggcacgggcgacauucuaguggacugcagugggggucaacaacacuuucuaaaagacaaccucaucgaccuggggugcccgcacaucccccugcucggccggauggccaucuauaucugccgcaugagcaaccacccccggaccacuauggccuucuuguuuugguucuccuuuggcuacgugauuaccugcaucuucugcaaggcccuguucuauucgcucaucaucaucggaacccuggguaagaagaucaagcaguaccgcgagcugaagccccagacgugcaccaucugcgagaccgcgccggugaacgccaucgacgccgagaugcacgaccucaacugcuccuacaacaucugccccuacugcgcgagcaggcugaccuccgacggacuggcgcgccacgugacgcaaugccccaagcggaaggagaaggucgaggagaccgagcucuaccugaaccuggagcgcaucccguggaucgugcggaagcucuuacaggugagcgagagcaccggcgucgcccugaagcgcuccagcuggcugaucgugcugcugguacuccugaccgucucccugagccccgugcaguccgcccccgucgggcacggcaagacgaucgagaucuaccagacccgggagggcuucgcuagcaucugccucuucaugcugggguccauccuauucaucgucagcugccucgugaagggccugguggacuccguuagcgaguccuucuuccccgggcugucggugugcaagacaugcuccaucggcagcgugaacggguucgagaucgagucccacaagugcuacugcagccucuucuguugcccguacugccgucacugcagugccgaccgggagauccaccagcuucaucugagcaucugcaagaagcgcaagaccggcuccaacgucaugcucgcugugugcaagcggaugugcuuccgcgccacgaucgaggcaagccgucgggcucugcugauacgcagcauaaucaacaccaccuucgugaucugcauccucacccugacgaucugcgucguguccaccagcgccguggagauggagaaccugcccgccggcaccugggagcgggaagaggaccucaccaacuucugccaccaggagugccaggucacggagaccgagugccugugccccuaugaagcccuggugcuccgcaagccccuguuucuggacuccaucgugaaggggaugaaaaaccuccugaacagcaccucccuggagaccagccuguccaucgaggccccguggggcgccaucaacgugcagagcacauucaagcccaccguguccacugccaacaucgcgcugagcuggucuagcgugguccaccgggggaacaagauccugguuaccggccgcuccgagagcaucaugaagcucgaggagcggacggggguauccugggaccugggcguagaggacgccagcgagucgaagcugcucaccgugagcaucauggaccugucccagauguacagccccguguucgaguaucugagcggcgaccgccagguagaggaguggcccaaggcuaccugcaccggugacugcccggagcggugcggcugcacgucgagcaccugucuccacaaggaauggucccacagccgcaacuggcggugcaaccccaccuggugcuggggcguggggaccggaugcacgugcugcggcguggacgucaaggaccuauuuaccgaccacauguucgugaaguggaagguggaauacaucaaaaccgaagccaucguuugcguggcgcugaccucccaggagcgccagugcagccucaucgaggccggaacccgguuuaaccuagggccggugacgauuacccucuccgagccccgcaacauccagcagaaacucccgcccgagauuaucacccugcaccccaaaaucgaggagggcuuuuucgaucugaugcacguccagaaggugcucagcgccuccaccgugugcaagcugcagagcugcacgcacgggauccccggcgaccugcaggucuaccauaucggcaaccuccugaagggggaccgcgugaacggccaccugauccacaagaucgagucccacuucaacaccagcuggauguccugggacgggugugaccucgacuacuacugcaacaugggcgacuggccgagcugcaccuacaccggggucacucagcacaaccacgccgccuucgugaaccugcugaacaucgagaccgacuacaccaagaccuuccacuuucacuccaagcgcguaacggcgcauggcgacaccccucagcucgaccugaaggcccggcccaccuacggcgccgggggcaucaccguccuggucgagguggcugacauggagcuccacacuaagaaggucgaaaucagcggacugaaguucgccucccucgcgugcaccggcugcuacgccugcagcagugggaucagcugcaagguacgcauccacguggacgagccggacgagcucacuguccacguaaagagcagcgacccggacgugguugccgcgucgaccucacugauggcccggaaacuggaguucggcacggacucaacguuuaaggcguucuccgccaugcccaagaccagccucugcuucuacaucguggagcgcgaguacugcaaguccugcagcgaggacgacacccagaaguguguggacacgcggcuggagcaaccccaguccauacugaucgagcacaaaggcacaaucaucgggaagcagaacgauaccugcaccgccaaggccagcugcuggcucgaguccgucaagaguuucuucuacggccugaagaacaugcugggguccguguucggcaaccuauucaucgggauccuccuguuccucgcgcccuucguguuacucguccuguuuuucauguucggcuggaagauccucuucugcuucaaguguugccgccgcacgcggggccuguucaaguaccgccaccugaaggacgacgaggagaccggguaccggagaaucaucgagcgacucaauagcaagaagggcaagaaccgccugcuggacggggaccgacucgccgaccgcaagauagccgagcuauucuccaccaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17085 - RNA, 3961 nt, Artificial Sequence
  mRNA product Design2 comprising derived and/or modified sequence from CCHVF(10200)__U39455.2__SP-GP_Gn-NSm-Gc (opt11)
ggggcgcugccuacggagguggcagccaucuccuucucggcaucaagcuuaccaugcacaucagccugauguacgccauccucugccugcagcugugcggccucggggagacccacggcucccacaacgagaccagcgaggagcccuccgacgacugcgugagccgcacgcagcugcugcggaccgagaccgccgagauccacggggacaacuacggcgggccgggcgacaagaucaccaucugcaacggcuccacgaucgucgaccagcgccucgggagcgagcugggcugcuacaccaucaaccgggugcgcuccuucaagcugugcgagaacagcgcgaccgggaagaacugcgagaucgacuccgugcccgucaagugccggcagggcuacugccuccgcaucacccaggaggggcggggccacgugaagcugagccgcggcuccgaggugguccuggacgccugcgacacgagcugcgagaucaugauccccaaggggaccggcgacauccucguggacugcuccgggggccagcagcacuuccugaaggacaaccugaucgaccucggcugccccaagaucccgcugcuggggaagauggccaucuacaucugccggaugagcaaccaccccaagaccaccauggccuuccucuucugguucuccuucggcuacgugaucacgugcauccugugcaaggccaucuucuaccugcucaucaucgucgggacccugggccgccggcugaagcaguaccgcgagcucaagccccagaccugcaccaucugcgagacgacccccgugaacgcgaucgacgccgagaugcacgaccugaacugcagcuacaacaucugcccguacugcgccucccggcugaccagcgacgggcucgcccgccacgugauccagugccccaagcggaaggagaaggucgaggagaccgagcuguaccugaaccucgagcgcauccccuggguggugcggaagcugcugcaggucuccgagagcacgggcguggcgcucaagcgcagcuccuggcugaucgugcugcucguccuguucaccgugagccugucccccgugcagagcgccccgaucggccaggggaagaccaucgaggccuaccgggcccgcgagggcuacaccuccaucugccucuucguccuggggagcauccuguucaucguguccugccucaugaagggccugguggacagcgucgggaacuccuucuuccccggccugagcaucugcaagacgugcuccaucagcuccaucaacggcuucgagaucgagagccacaagugcuacugcucccucuucugcugccccuacugccggcacugcagcaccgacaaggagauccacaagcugcaccuguccaucugcaagaagcgcaagaccgggagcaacgugaugcucgccgucugcaagcugaugugcuuccgcgcgaccauggagguguccaaccgggcccuguucauccgcagcaucaucaacacgaccuucgugcugugcauccucauccuggccgucugcguggugagcaccuccgccgucgagauggagaaccugcccgccggcaccugggagcgggaggaggaccucacgaacuucugccaccaggagugccaggugaccgagaccgagugccugugcccguacgaggcgcuggugcuccgcaagccccuguuccuggacagcaccgccaaggggaugaagaaccuccugaacuccacgagccuggagaccucccucagcaucgaggcccccuggggcgccaucaacguccaguccaccuacaagcccaccgugagcaccgccaacaucgcgcuguccuggagcuccguggagcaccgggggaacaagauccuggucagcggccgcuccgagagcaucaugaagcucgaggagcggacgggcaucuccugggaccuggggguggaggacgccagcgaguccaagcugcucaccgugagcgucauggaccugagccagauguacuccccgguguucgaguaccugagcggcgaccgccagguggaggaguggcccaaggccaccuguaccggggacugccccgagcggugcggcugcacguccagcacaugccuccacaaggaguggccccacucccgcaacuggcggugcaacccgaccuggugcuggggcgucgggaccggcugcacgugcugcgggcuggacgugaaggaccuguucaccgacuacauguucgugaaguggaaggucgaguacaucaagaccgaggccaucgugugcguggagcucaccagccaggagcgccagugcucccugaucgaggccggcacgcgguucaaccuggggcccgucaccaucacccucagcgagccccgcaacauccagcagaagcugcccccggagaucaucacccugcacccccggaucgaggagggcuucuucgaccucaugcacgugcagaaggugcuguccgcgagcacggucugcaagcugcaguccugcacccacggcgugcccggggaccuccagguguaccacaucggcaaccugcugaagggggacaaggucaacggccaccucauccacaagaucgagccgcacuucaacaccagcuggauguccugggacgggugcgaccuggacuacuacugcaacaugggcgacuggcccagcugcaccuacacgggcgugacccagcacaaccacgccuccuucgugaaccugcucaacaucgagaccgacuacaccaagaacuuccacuuccacagcaagcgcgucacggcccacggggacaccccccagcuggaccugaaggcccggcccaccuacggcgcgggggagaucaccgugcucguggaggucgccgacauggagcugcacacgaagaagaucgagaucuccggccugaaguucgccagccucgccugcaccgggugcuacgccugcuccagcagcaucuccugcaaggugcgcauccacguggacgagccggacgagcugaccguccacgugaagagugacgaccccgacguggucgcggccuccagcucccugauggcccggaagcucgaguucggcaccgacagcacguucaaggccuucuccgccaugcccaagaccagccugugcuucuacaucguggagcgcgagcacugcaaguccugcagcgaggaggacaccaagaagugcgugaacaccaagcuggagcagccccaguccauccucaucgagcacaagggcacgaucaucgggaagcagaacagcacaugcaccgcgaaggccuccugcuggcuggagagcgucaaguccuucuucuacggccugaagaacaugcucagcgggaucuucggcaacguguucauggggaucuuccuguuccuggccccguucauccuccugauccuguucuucauguucggcuggcgcauccucuucugcuucaagugcugccggcgcacccggggccuguucaaguaccgccaccugaaggacgacgaggagaccggguaccggcgcaucaucgagaagcucaacaacaagaagggcaagaacaagcugcuggacggggagcggcucgccgacggccgcaucgccgagcuguucuccacgaagacccacaucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17086 - RNA, 3934 nt, Artificial Sequence
  mRNA product Design2 comprising derived and/or modified sequence from CCHVF(10200)__U39455.2__IgE-leader_Gn-NSm-Gc (opt11)
ggggcgcugccuacggagguggcagccaucuccuucucggcaucaagcuuaccauggacuggaccuggauccuguuccucguggcagccgcgacucgcguacacucauccgaggagcccagcgacgacuguguguccagaacgcagcuguugcgcacggagacggccgagauccacggcgacaacuacgggggcccgggggacaagaucaccauaugcaacggcagcaccaucguagaccagcggcucggguccgagcuaggcuguuacaccaucaaccguguccggagcuucaagcugugcgaaaauucagccaccggcaaaaacugcgagaucgacagcguucccgugaagugucgccagggguacugccuccggaucacccaggagggcagagggcacgucaaguuaucucggggcagcgagguagugcuggacgcgugcgacacguccugcgagaucaugauacccaaggggaccggcgacauccucgucgacugcagcggcgggcaacagcacuuccugaaggacaaccugaucgaucucggcugccccaagaucccgcuacuggggaaaauggccaucuacaucugccgaauguccaaccacccaaagaccaccauggcguuccucuucugguucagcuucggguacgugaucacaugcauucugugcaaggccaucuucuaccugcucaucaucgugggcacccuggggcggcgccugaaacaguacagagagcucaagccccagaccugcaccaucugcgagaccaccccggucaacgcgauugaugccgagaugcacgaccuaaacuguuccuacaacaucugcccguacugcgcgagccgccugacguccgacggccucgcccggcacgugauccagugccccaagcgcaaggagaagguggaggagaccgaguuauaccucaaccuagagcggaucccuugggucguucggaaguugcuccaggugagcgaguccacggggguugcccucaagaggagcagcuggcugaucgugcugcucguacuguucaccgucagucugagccccgugcaguccgcuccgaucgggcaggggaagaccaucgaggcguaucgggccagggagggcuacaccagcaucugccucuucguccugggcuccauccuguucaucgucagcugccugaugaaggggcugguggacagugucggcaacagcuucuuccccgggcuaagcaucugcaagacgugcagcaucuccuccaucaacggcuucgagaucgaaucccacaagugcuacugcucccucuucugcugccccuacugccgccauugcuccaccgacaaggagauccacaagcugcaccugucaaucugcaagaagaggaaaaccggguccaacgugaugcuagccgugugcaagcugauguguuuccgggcuaccauggaggucagcaaccgcgcccuguucauuagguccauuaucaauaccacuuucgugcucugcauccugauccuggcggugugcgucgugagcaccagcgcaguggaaauggagaaccuaccugccggcaccugggagcgggaggaggaucucacgaacuucugccaccaggagugucaggucacagagaccgagugccuuugcccguacgaggcccugguacucaggaagccccuguuucuggacuccaccgccaagggcaugaaaaaccuccugaacuccacaucccuggagaccagccucuccauagaggcccccuggggcgcgaucaacgugcagucaaccuacaaacccaccgucuccaccgcuaacauugcccugagcugguccucgguggagcacagggggaacaagauucugguguccgggcggucagagagcaucaugaagcucgaggagcgcacgggcaucagcugggaucugggggucgaagaugccuccgagagcaaguugcucacagugaguguaauggaccugagccagauguacagcccgguuuucgaguaccuguccggcgaccgccagguggaagaguggcccaaggcaacuugcacaggcgacugccccgagcggugcgggugcacgagcucgaccugccuucauaaagaguggccacacagccggaacuggcgcugcaacccgaccuggugcuggggcguggggaccggguguacgugcugcgggcuggacgucaaggaccuguucaccgacuacauguucgugaaguggaagguggaguacaucaagaccgaggcgaucgucugcguggagcucaccucgcaggagcgucagugcagccugaucgaggccgggacgcgcuucaaccugggccccgugaccaucacccucuccgaaccgcggaacauccaacaaaagcugccaccggagaucaucacccugcacccccgcauugaggagggcuucuucgaccucaugcacguccaaaaggugcugagcgcaucuacugugugcaaacugcagagcuguacccacggaguacccggggaccuccaaguauaccacaucgguaaucugcugaagggagacaaggugaacgggcaucucauccacaagaucgagccgcacuucaauaccuccuggaugagcugggacggcugcgaccuggauuacuauugcaacaugggggacuggccguccugcacuuauacgggcguuacucagcacaaucacgccagcuucgugaaccuacucaacauagagaccgacuacaccaaaaauuuccacuuucacuccaagcgggugacagcacacggggacacuccccaacuggaccugaaggcccgccccaccuauggcgccggagagauaacgguccucguggagguggccgacauggagcugcacacgaagaagaucgagaucagcggguugaaguucgccucccucgccugcaccggaugcuaugcgugcagcuccagcaucucaugcaagguccggauccacguggacgagccggacgagcugaccgugcacguaaaaagcgacgaccccgaugucguggccgccagcuccagccugauggcgcgcaaacucgaguucgggaccgacuccaccuucaaggcguucagcgcaaugcccaagacgagccugugcuucuacaucgucgagagagagcacugcaagagcugcucagaggaggacaccaaaaagugcgugaacaccaagcuggagcagccccagagcauccuaaucgaacauaaggggacaaucaucgggaagcagaacuccacuugcaccgcgaaagccucuugcuggcuagagucuguaaagagcuucuucuacgggcuaaagaacaugcucuccggcaucuucgggaauguuuucaugggcaucuucuuauuccucgcgcccuucauccuccugauccuguucuuuauguucggauggcggauucuguucuguuucaagugcugccgccggacccgcggccuuuucaaguacagacauuugaaagacgacgaggagaccggguacagaagaaucaucgagaagcucaacaacaagaaaggcaagaacaagcugcuggacggcgaacggcucgcugacgggcggaucgccgaacucuucagcacgaagacccauauuggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17087 - RNA, 3355 nt, Artificial Sequence
  mRNA product Design2 comprising derived and/or modified sequence from CCHVF(10200)__U39455.2__IgE-leader_Gn-4aa-Gc (opt11)
ggggcgcugccuacggagguggcagccaucuccuucucggcaucaagcuuaccauggacuggaccuggauccucuuucugguugccgcagccacccgcguucacuccagcgaagaacccucggacgacugcguuaguagaacucaacuccuacggacagaaaccgcagagauccacggcgauaacuacggcggccccggcgacaagauuacuaucugcaacggcagcaccaucgucgaccaacgacucggcucagaacuaggcugcuacaccauuaaccgcguccgcagcuucaaacuaugcgagaacagcgcgaccgggaagaacugcgaaaucgacucaguaccugucaaaugcagacaaggauacugccugcgaaucacccaagaaggucgcggacacgucaagcuaucccgcggaucagaaguuguucuggacgcgugcgacaccaguugcgaaaucaugauaccaaaaggcaccggugacauucucguagacugcagcggcggccaacaacacuuuuuaaaagacaaccucaucgaccucggaugcccaaaaauaccucuccucgguaaaauggcuaucuacauaugcaggaugucuaaccaucccaaaacaacgauggcuuuccuuuucugguucuccuuuggguacgucauaaccugcauacucugcaaagcaaucuucuaccuccucaucaucguagggacacuaggacgccgauuaaaacaguaccgcgagcuaaaaccacaaacaugcacaauuugcgagacaacaccagucaacgcaaucgaugcugaaaugcacgaccucaacuguucauauaacaucugccccuacugcgccucgcgucuaaccucagacggccucgccagacacgucauccaaugccccaagcgcaaggaaaaggucgaagaaaccgaacuauacuugaaccuagaacgcaucccguggguugucagaaaacugcuucaggucucagaaucuaccggaguagcccucaagcgcucauccuggcucauuguacugcucguacucuuuaccgugagcuuaagcccaguccaauccgcccccaucggccgaaaaccacuauuccucgauuccacagccaaagguaugaaaaaccuccucaauucgaccucccucgaaaccucccucucgaucgaagcccccuggggcgccauaaacguccaauccacuuacaaaccuacugugucuacagcaaauaucgcccuauccuggucuuccguagagcaccgcgggaacaaaauacucguaucuggccgcuccgagagcaucaugaagcucgaagaacgcaccggaaucuccugggaccuuggcguagaggaugcgucagaaucaaagcuccuuaccgucagcgucauggaccuaucgcaaauguacuccccagucuucgaauaccugagcggcgaccgccagguggaagaguggcccaaagcaaccugcaccggggacugccccgaacggugcgguugcacuucgucaacaugccuucacaaagaauggccccacagccggaacuggcgcuguaaccccacauggugcuggggcgucgguaccggauguacaugcugcggacuugauguaaaggaccuuuucaccgacuauauguucguuaaguggaagguugaauacaucaaaacagaagcaauagucugcgucgagcucacaucccaagagcgucaaugcucccuaauagaagcuggaacccgcuuuaacuuagguccggucacaauaacacuaucagaaccucgcaauauccaacaaaagcucccucccgaaaucaucacccuucacccccgcaucgaagaaggauucuucgaccucaugcacguccaaaaagugcucagcgccagcacagucuguaaacuccaauccuguacccacggcguacccggagaccuacaaguuuaucacauagggaaucuccuaaaaggggacaaagucaauggccaccucauacacaaaaucgagccacacuucaacaccagcuggauguccugggacgggugcgaucuagacuacuacugcaacaugggggacuggcccucuugcaccuacacgggagucacacagcacaaucacgccucauucguaaaccuucuaaacaucgaaacggacuacacuaaaaauuuccacuuccacucgaaaagggucacagcacacggcgacacaccccagcucgaccucaaagcccgccccaccuacggcgcaggagaaaucacaguacucguugaaguagccgacauggagcuacauaccaagaaaaucgaaaucucaggacucaaauuugccucacuagccugcacgggcugcuacgcaugcucaucuuccaucuccugcaaaguacgcauccacgucgacgaaccagacgagcucaccguccaugucaaaagcgaugacccagacguggucgccgcuuccagcucucuuauggcucgaaaacuagaguucggcacagacuccaccuucaaggcuuucucggccaugcccaaaaccucgcucugcuucuacaucguugagcgggagcacuguaaauccugcuccgaagaagauaccaaaaagugcgucaacaccaaacucgagcaaccgcaguccauucucaucgaacacaaaggcacaaucaucggaaaacaaaacagcacaugcaccgccaaggcauccuguuggcuugaaagcgugaaguccuucuucuacggacucaaaaacaugcuauccggcaucuucggcaacgucuucaugggaaucuuccuguuucuggcccccuuuauacuccuaauacucuucuucauguucggauggcgcauccucuuuugcuucaaauguugcagacgaacacgcggccucuucaaauaccgccaccucaaagacgacgaagaaacgggcuaucgcagaauaaucgaaaaauugaacaacaagaaaggcaaaaacaaacuccuggacggagaacgauuagccgacggcaggauagccgaacuauuuucaaccaaaacgcacauagguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17088 - RNA, 1411 nt, Artificial Sequence
  mRNA product Design2 comprising derived and/or modified sequence from CCHVF(10200)__U39455.2__IgE-leader_Gn (opt11)
ggggcgcugccuacggagguggcagccaucuccuucucggcaucaagcuuaccauggacuggaccuggauccucuuccuaguugccgccgcuacccgcguccacuccucagaggaacccuccgacgacugcgucucccgcacucaacucuuacgcaccgaaacagccgagauccacggcgacaacuacgggggacccggcgacaaaaucaccauaugcaacggcuccaccaucgucgaccaacgccucggcucagaacucggcugcuacacgaucaaccgaguccgcucuuucaaacucugugaaaacucagcaaccggcaaaaacugugaaaucgacuccguacccgugaaaugcagacaaggauauugccuccgaaucacccaagaaggacgcggccacgucaaacucagccgaggcucagaagucguccucgacgccugcgacaccucaugcgaaaucaugauccccaaaggaaccggcgacauccucgucgacugcuccggcggccaacaacacuuccuuaaagacaaccucauagaccucggaugccccaaaauaccucuacuagggaaaauggccaucuacauaugccgcauguccaaccaccccaaaacaacuauggccuuccuuuucugguucucguucggcuacgucaucacaugcauccucugcaaagccaucuuuuaccuacuuaucaucguaggcacccuaggccgccgucuaaaacaauaccgcgaacucaaaccccaaaccugcaccaucugcgaaaccacccccguaaacgccaucgacgcagaaaugcacgaccuaaacugcuccuacaacaucugcccauacugcgccucccgccuaaccuccgacggacucgcccgccacgucauccaaugccccaaacgcaaagaaaaaguagaagaaacagaacuauaccuaaaccuagaacgcauaccgugggucguccguaaacuccuccaagucucagaauccaccggcgucgcacucaaacgaucaagcuggcuaaucguccuccucguccucuucaccgucucacuaucccccguccaauccgcccccaucggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17089 - RNA, 2371 nt, Artificial Sequence
  mRNA product Design2 comprising derived and/or modified sequence from CCHVF(10200)__U39455.2__IgE-leader_Gc (opt11)
ggggcgcugccuacggagguggcagccaucuccuucucggcaucaagcuuaccauggacuggaccuggauccucuuccucgucgccgccgcaacacgcguucacagcuuccucgacagcaccgccaagggcaugaaaaaccuacucaacucgaccucccuagagacaucccucuccaucgaagcccccuggggagccaucaacguccaauccaccuacaaaccaaccguguccacggccaacauagcgcuaagcugguccagcgucgagcaccgaggaaacaagauccuagucucgggccgaagcgaaucaauaaugaagcucgaggaacgcacgggaaucucaugggaucucggcgucgaagacgcaagcgaaucaaaacuccuuacagugagcgucauggaccuuucacaaauguacucgcccguauucgaauaccuuagcggagaccgccaaguugaagaguggcccaaagcgaccugcaccggcgacugccccgaacguuguggcuguacaucgagcacaugccuacacaaagaauggccacauuccagaaacuggcgcugcaacccgaccuggugcuggggcgugggcacaggcugcacaugcugcggccuugacgucaaagaccuauucaccgacuacauguucgucaaauggaaaguagaauacauaaaaaccgaagcaauagucugcgucgaacuaaccucccaagaacgacaaugcucacucauagaagcuggaacccgcuucaaccucggacccguaacgaucacucucuccgaaccccgaaacauccagcaaaaacucccucccgaaaucauaacccuacacccacguaucgaagaaggcuucuucgaccuaaugcacgugcaaaaaguacucagcgcguccaccguuugcaaacuccaaucuugcacucacggcguacccggcgaccugcaagucuaccacaucggcaaccuccucaagggcgacaaaguaaauggucaccugauccacaaaaucgagccccacuucaacaccuccuggaugagcugggacggaugcgaccucgacuacuacugcaacaugggagacuggcccucaugcacguacaccggcgucacccaacacaaccacgccucauucguaaaccugcugaacaucgaaaccgacuauaccaagaacuuccacuuccacagcaaaagagucaccgcccacggcgacacaccccaauuagaccucaaagcccgccccaccuacggcgccggcgaaauaaccguccucgucgaagucgcagacauggaacuacacacaaagaaaauagaaauuuccggccugaaauucgcaucacucgcaugcacaggcugcuacgcgugcucaagcucaauauccuguaaaguccgaauccacguagaugaaccagacgagcucaccguacacgucaagucagacgacccagacguaguagcggccucauccucccucauggcacgaaaacuagaguucggcacagacucaacauucaaagcauucagcgcaaugccaaaaaccucccuuugcuucuacaucgucgaacgcgaacacugcaaaagcugcagcgaagaagacacaaagaaaugcguuaacaccaaacuugaacaaccccaaagcauccugauagaacacaaaggcacuaucaucggaaagcagaacucaaccugcacugccaaggccagcugcuggcucgaaagcgugaaaucauucuuuuacggacugaaaaacaugcuaagcggcauuuucgguaacguauucaugggcaucuuccucuuccuggccccguucauccucuuaauacuauuuuucauguucggcuggagaauccuauucuguuucaaaugcugccgccgcacgcgcggccuuuuuaaauaucgccaccuuaaggacgaugaagaaaccggcuaccgccgaauaauagaaaaacuaaacaacaaaaagggcaaaaacaaacuccucgacggcgaacgccuugcagacggccgcauagccgaacucuucagcacaaaaacccacauaggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17090 - protein, 235 aa, Artificial Sequence; identical to SEQ ID NO: 792
  derived and/or modified protein sequence (wt) from LACV(Human/78)__NC_004110.1__N

SEQ ID NO: 17091 - protein, 1441 aa, Artificial Sequence; identical to SEQ ID NO: 1929
  derived and/or modified protein sequence (wt) from LACV(Human/78)__NC_004109.1__GP

SEQ ID NO: 17092 - protein, 1446 aa, Artificial Sequence
  derived and/or modified protein sequence (wt) from LACV(Human/78)__NC_004109.1__IgE-leader_Gn-NSm-Gc
MDWTWILFLVAAATRVHSSPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEDLPDDMLEMASRINSYYLTCILNYAVSWGLVIIGLLIGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAIGQEELDAVKKSKCWEIEYPDVKLIQEGDGTKSCRMKDSGNCNVATNRWPVIQCENDKFYYSELQKDYDKAQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKVEASMALVDAKPIIELAPVDQTAYIREKDERCKTWMCRVRDEGLQVILEPFKNLFGSYIGIFYTFIISIVVLLVIIYVLLPICFKLRDTLRKHEDAYKREMKIR

SEQ ID NO: 17093 - protein, 1231 aa, Artificial Sequence
  derived and/or modified protein sequence (wt) from LACV(Human/78)__NC_004109.1__SP-GP_Gn-4aa-Gc
MICILVLITVAAASPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGIIYNKSCKKCKLCGLVYHPFTECGTHCVCGARYDTSDRMKLHRASGLCPGYKSLRAARYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAIGQEELDAVKKSKCWEIEYPDVKLIQEGDGTKSCRMKDSGNCNVATNRWPVIQCENDKFYYSELQKDYDKAQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKVEASMALVDAKPIIELAPVDQTAYIREKDERCKTWMCRVRDEGLQVILEPFKNLFGSYIGIFYTFIISIVVLLVIIYVLLPICFKLRDTLRKHEDAYKREMKIR

SEQ ID NO: 17094 - protein, 1236 aa, Artificial Sequence
  derived and/or modified protein sequence (wt) from LACV(Human/78)__NC_004109.1__IgE-leader_Gn-4aa-Gc
MDWTWILFLVAAATRVHSSPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGIIYNKSCKKCKLCGLVYHPFTECGTHCVCGARYDTSDRMKLHRASGLCPGYKSLRAARYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAIGQEELDAVKKSKCWEIEYPDVKLIQEGDGTKSCRMKDSGNCNVATNRWPVIQCENDKFYYSELQKDYDKAQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKVEASMALVDAKPIIELAPVDQTAYIREKDERCKTWMCRVRDEGLQVILEPFKNLFGSYIGIFYTFIISIVVLLVIIYVLLPICFKLRDTLRKHEDAYKREMKIR

SEQ ID NO: 17095 - RNA, 708 nt, Artificial Sequence; identical to SEQ ID NO: 3127
  derived and/or modified CDS sequence (wt) from LACV(Human/78)__NC_004109.1__N

SEQ ID NO: 17096 - RNA, 708 nt, Artificial Sequence
  derived and/or modified CDS sequence (wt) from LACV(Human/78)__NC_004109.1__N
augucggauuugguguuuuaugaugucgcaucaacaggugcaaauggauuugauccugaugcaggguauauggacuucuguguuaaaaaugcagaauuacucaaccuugcugcaguuaggaucuucuuccucaaugccgcaaaggccaaggcugcucucucgcguaagccagagaggaaggcuaacccuaaauuuggagaguggcaggucgagguuaucaauaaucauuuuccuggaaacaggaacaacccaauugguaacaacgaucuuaccauccacagauuaucuggguauuuagccagauggguccuugaucaguauaacgagaaugaugaugagucucagcacgaguugaucagaacaacuauuaucaacccaauugcugagucuaaugguguaggaugggacagugggccagagaucuaucuaucauucuuuccaggaacagaaauguuuuuggaaacuuucaaauucuacccgcugaccauuggaauccacagagucaagcaaggcaugauggacccucaauaccugaagaaggccuuaaggcaacgcuauggcacucucacagcagauaaguggaugucacagaagguugcagcaauugcuaagagccugaaggauguagagcagcuuaaauggggaaaaggaggccugagcgauacugcuaaaacauuccugcagaaauuuggcaucaggcuuccauaa

SEQ ID NO: 17097 - RNA, 4326 nt, Artificial Sequence; identical to SEQ ID NO: 4264
  derived and/or modified CDS sequence (wt) from LACV(Human/78)__NC_004109.1__GP

SEQ ID NO: 17098 - RNA, 4326 nt, Artificial Sequence
  derived and/or modified CDS sequence (wt) from LACV(Human/78)__NC_004109.1__GP
augauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaguucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauag

SEQ ID NO: 17099 - RNA, 4341 nt, Artificial Sequence
  derived and/or modified CDS sequence (wt) from LACV(Human/78)__NC_004109.1__IgE-leader_Gn-NSm-Gc
auggacuggaccuggauccuguuccucguggccgccgcgacccgcguccacagcagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauag

SEQ ID NO: 17100 - RNA, 4341 nt, Artificial Sequence
  derived and/or modified CDS sequence (wt) from LACV(Human/78)__NC_004109.1__IgE-leader_Gn-NSm-Gc
auggacuggaccuggauccuguuccucguggccgccgcgacccgcguccacagcagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaguucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauag

SEQ ID NO: 17101 - RNA, 3696 nt, Artificial Sequence
  derived and/or modified CDS sequence (wt) from LACV(Human/78)__NC_004109.1__SP-GP_Gn-4aa-Gc
augauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagauacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauag

SEQ ID NO: 17102 - RNA, 3696 nt, Artificial Sequence
  derived and/or modified CDS sequence (wt) from LACV(Human/78)__NC_004109.1__SP-GP_Gn-4aa-Gc
augauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagauacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaguucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauag

SEQ ID NO: 17103 - RNA, 3711 nt, Artificial Sequence
  derived and/or modified CDS sequence (wt) from LACV(Human/78)__NC_004109.1__IgE-leader_Gn-4aa-Gc
auggacuggaccuggauccuguuccucguggccgccgcgacccgcguccacagcagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagauacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauag

SEQ ID NO: 17104 - RNA, 3711 nt, Artificial Sequence
  derived and/or modified CDS sequence (wt) from LACV(Human/78)__NC_004109.1__IgE-leader_Gn-4aa-Gc
auggacuggaccuggauccuguuccucguggccgccgcgacccgcguccacagcagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagauacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaguucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauag

SEQ ID NO: 17105 - RNA, 708 nt, Artificial Sequence; identical to SEQ ID NO: 5462
  derived and/or modified CDS sequence (opt4) from LACV(Human/78)__NC_004109.1__N

SEQ ID NO: 17106 - RNA, 4326 nt, Artificial Sequence; identical to SEQ ID NO: 9367
  derived and/or modified CDS sequence (opt4) from LACV(Human/78)__NC_004109.1__GP

SEQ ID NO: 17107 - RNA, 4341 nt, Artificial Sequence
  derived and/or modified CDS sequence (opt4) from LACV(Human/78)__NC_004109.1__IgE-leader_Gn-NSm-Gc
auggacuggaccuggauccuguuccucguggccgcugcaacaagaguccacagcagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaaggcccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagguggaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggugcugcuggugaucaucuacgugcugcugcccaucugcuucaagcugagagacacccugagaaagcacgaggacgccuacaagagagagaugaagaucagauga

SEQ ID NO: 17108 - RNA, 3696 nt, Artificial Sequence
  derived and/or modified CDS sequence (opt4) from LACV(Human/78)__NC_004109.1__SP-GP_Gn-4aa-Gc
augaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagauacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaaggcccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagguggaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggugcugcuggugaucaucuacgugcugcugcccaucugcuucaagcugagagacacccugagaaagcacgaggacgccuacaagagagagaugaagaucagauga

SEQ ID NO: 17109 - RNA, 3711 nt, Artificial Sequence
  derived and/or modified CDS sequence (opt4) from LACV(Human/78)__NC_004109.1__IgE-leader_Gn-4aa-Gc
auggacuggaccuggauccuguuccucguggccgcugcaacaagaguccacagcagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagauacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaaggcccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagguggaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggugcugcuggugaucaucuacgugcugcugcccaucugcuucaagcugagagacacccugagaaagcacgaggacgccuacaagagagagaugaagaucagauga

SEQ ID NO: 17110 - RNA, 708 nt, Artificial Sequence; identical to SEQ ID NO: 6154
  derived and/or modified CDS sequence (opt3) from LACV(Human/78)__NC_004109.1__N

SEQ ID NO: 17111 - RNA, 4326 nt, Artificial Sequence; identical to SEQ ID NO: 11010
  derived and/or modified CDS sequence (opt3) from LACV(Human/78)__NC_004109.1__GP

SEQ ID NO: 17112 - RNA, 4341 nt, Artificial Sequence
  derived and/or modified CDS sequence (opt3) from LACV(Human/78)__NC_004109.1__IgE-leader_Gn-NSm-Gc
auggacuggaccuggauccuguuccucguggccgcugcaacaagaguccacagcagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgggugaugugcaaaucaaagggcccagccagcauucuuaguaucauuacagcaguucugguguugaccuucgucacucccauaaacucuauggugcucggggaauccaaagagacauuugagcuggaagauuuaccugacgacaugcuggagauggcuagccgcaucaauucguauuaccucaccuguauucuuaacuaugccguaucuuggggacugguuaucaucggcuugcuaauuggucugcucuuuaagaaguaccaacaccgauuucugaauguguaugcgauguacugcgaagagugugauauguaccacgacaaauccgggcuuaagagacauggagauuucacgaacaaaugcaggcaguguaccugcggccaguaugaagacgccgcaggccugauggcucaccggaagacauacaauugcuugguccaguauaaagccaaguggaugaugaacuuccucauaaucuacauuuuucugaucuuaauuaaggauucagcuaucgugguccaagccgcagggacugacuucaccacaugucuggagacugagaguauaaacuggaauugcaccggaccauuucuaaaccucgguaauugucagaaacagcaaaagaaagaaccguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacgacuucgaggcuuguauucuguacccaaaccagcauuuuuguaggugcgucaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauaucgcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaaaaugugaaggacguugccugcuuauccccgcgcucaggagcgauuuaugccagcaucaucgcuuguggugaaccuaacggccccucuguguacagaaagccauccgggggagucuuccagaguagcacugauaggucuauuuauugccugcuugacucccauugcuuggaggaguuugaagcaaucggccaagaggaacucgaugccgugaaaaagucaaaauguugggagauugaguacccugacguaaagcugauacaggaaggugacgggacaaaaaguugccggaugaaggauagcggcaauuguaacguggcuaccaaucgcuggcccguuauccagugcgagaacgacaaguucuacuauucggaacuacagaaagauuacgacaaggcccaagauauuggacacuauugucuguccccaggcugcacaacugucagauaccccaucaauccuaaacauauuucuaacuguaauuggcaagugagcaggucaaguaucgcaaagauagacgugcacaacaucgaggauauugaacaguauaaaaaggcgaucacccagaagcuccaaacgucccugucucuuuuuaaauacgccaagaccaaaaauuugccacacauuaagccgaucuauaaauacauaacaauugaggggacugagaccgcugaaggaaucgagagcgccuacaucgaauccgagguccccgcacuggcugguacaucaauuggcuucaagauaaacagcaaagaagggaagcauuuacucgacguuaucgccuaugugaagagugcaucuuacuccagcguguauacuaaacuguacucgaccggaccuacgucaggcauuaauacaaagcacgaugagcuuugcaccgguccaugucccgccaacaucaaucaucagguaggguggcugacuuuugcucgugagcggacaucuaguuggggcugcgaagaguucggauguuuggcggucuccgacggcugcguguuugggagcugccaggauauuaucaaagaggaacucucuguuuaucgaaaggaaaccgaggaggugacugacgucgaacugugucuaaccuucagcgauaaaacauacugcacgaaccugaacccugugaccccaauaaucacugaccucuuugagguucaauucaagacaguggaaaccuauucccugcccagaauuguagccguccagaaucacgagaucaagauuggacagaucaacgaccuuggcguguacucaaaagguugugggaaugugcagaaggucaacggaacaauauacggcaaugguguuccgagguuugauuauuugugccaucuggcaagucgcaaagaggugauuguacggaaguguuucgacaacgauuaccaggcuugcaaauuuuuacagagcccugccucuuauagacucgaagaggacuccggcacugugaccaucaucgauuacaagaagauucuggggacgaucaaaaugaaggccauacuuggagacgucaaauauaagacauucgcugauucaguggacauuaccgcagaaggcaguuguacugggugcaucaauuguuucgagaacauucacugcgaacugacccuacacacaacuaucgaggccagcuguccaauaaaauccucuugcaccguuuuucaugauaggauucucgugacacccaaugagcacaaguacgcgcugaagauggucugcacggaaaaaccuggaaacaccuugacuaucaagguguguaauacaaaaguugaggcuucgauggcccugguggacgcaaagcccaucauugaauuagccccagucgaucagaccgcuuauauccgcgagaaagacgaacgaugcaagacuuggaugugucggguacgugacgagggccuccaggugauucuggagccuuucaagaaccuuuuugguagcuacauagggaucuucuacacauuuauuaucucaaucguugugcuguuggucauuauauaugugcuccugcccaucugcuucaaacuaagagauacccugaggaagcaugaagacgcauacaaacgcgagaugaagauucgguga

SEQ ID NO: 17113 - RNA, 3696 nt, Artificial Sequence
  derived and/or modified CDS sequence (opt3) from LACV(Human/78)__NC_004109.1__SP-GP_Gn-4aa-Gc
augaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacgacuucgaggcuuguauucuguacccaaaccagcauuuuuguaggugcgucaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauaucgcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaaaaugugaaggacguugccugcuuauccccgcgcucaggagcgauuuaugccagcaucaucgcuuguggugaaccuaacggccccucuguguacagaaagccauccgggggagucuuccagaguagcacugauaggucuauuuauugccugcuugacucccauugcuuggaggaguuugaagcaaucggccaagaggaacucgaugccgugaaaaagucaaaauguugggagauugaguacccugacguaaagcugauacaggaaggugacgggacaaaaaguugccggaugaaggauagcggcaauuguaacguggcuaccaaucgcuggcccguuauccagugcgagaacgacaaguucuacuauucggaacuacagaaagauuacgacaaggcccaagauauuggacacuauugucuguccccaggcugcacaacugucagauaccccaucaauccuaaacauauuucuaacuguaauuggcaagugagcaggucaaguaucgcaaagauagacgugcacaacaucgaggauauugaacaguauaaaaaggcgaucacccagaagcuccaaacgucccugucucuuuuuaaauacgccaagaccaaaaauuugccacacauuaagccgaucuauaaauacauaacaauugaggggacugagaccgcugaaggaaucgagagcgccuacaucgaauccgagguccccgcacuggcugguacaucaauuggcuucaagauaaacagcaaagaagggaagcauuuacucgacguuaucgccuaugugaagagugcaucuuacuccagcguguauacuaaacuguacucgaccggaccuacgucaggcauuaauacaaagcacgaugagcuuugcaccgguccaugucccgccaacaucaaucaucagguaggguggcugacuuuugcucgugagcggacaucuaguuggggcugcgaagaguucggauguuuggcggucuccgacggcugcguguuugggagcugccaggauauuaucaaagaggaacucucuguuuaucgaaaggaaaccgaggaggugacugacgucgaacugugucuaaccuucagcgauaaaacauacugcacgaaccugaacccugugaccccaauaaucacugaccucuuugagguucaauucaagacaguggaaaccuauucccugcccagaauuguagccguccagaaucacgagaucaagauuggacagaucaacgaccuuggcguguacucaaaagguugugggaaugugcagaaggucaacggaacaauauacggcaaugguguuccgagguuugauuauuugugccaucuggcaagucgcaaagaggugauuguacggaaguguuucgacaacgauuaccaggcuugcaaauuuuuacagagcccugccucuuauagacucgaagaggacuccggcacugugaccaucaucgauuacaagaagauucuggggacgaucaaaaugaaggccauacuuggagacgucaaauauaagacauucgcugauucaguggacauuaccgcagaaggcaguuguacugggugcaucaauuguuucgagaacauucacugcgaacugacccuacacacaacuaucgaggccagcuguccaauaaaauccucuugcaccguuuuucaugauaggauucucgugacacccaaugagcacaaguacgcgcugaagauggucugcacggaaaaaccuggaaacaccuugacuaucaagguguguaauacaaaaguugaggcuucgauggcccugguggacgcaaagcccaucauugaauuagccccagucgaucagaccgcuuauauccgcgagaaagacgaacgaugcaagacuuggaugugucggguacgugacgagggccuccaggugauucuggagccuuucaagaaccuuuuugguagcuacauagggaucuucuacacauuuauuaucucaaucguugugcuguuggucauuauauaugugcuccugcccaucugcuucaaacuaagagauacccugaggaagcaugaagacgcauacaaacgcgagaugaagauucgguga

SEQ ID NO: 17114 - RNA, 3711 nt, Artificial Sequence
  derived and/or modified CDS sequence (opt3) from LACV(Human/78)__NC_004109.1__IgE-leader_Gn-4aa-Gc
auggacuggaccuggauccuguuccucguggccgcugcaacaagaguccacagcagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacgacuucgaggcuuguauucuguacccaaaccagcauuuuuguaggugcgucaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauaucgcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaaaaugugaaggacguugccugcuuauccccgcgcucaggagcgauuuaugccagcaucaucgcuuguggugaaccuaacggccccucuguguacagaaagccauccgggggagucuuccagaguagcacugauaggucuauuuauugccugcuugacucccauugcuuggaggaguuugaagcaaucggccaagaggaacucgaugccgugaaaaagucaaaauguugggagauugaguacccugacguaaagcugauacaggaaggugacgggacaaaaaguugccggaugaaggauagcggcaauuguaacguggcuaccaaucgcuggcccguuauccagugcgagaacgacaaguucuacuauucggaacuacagaaagauuacgacaaggcccaagauauuggacacuauugucuguccccaggcugcacaacugucagauaccccaucaauccuaaacauauuucuaacuguaauuggcaagugagcaggucaaguaucgcaaagauagacgugcacaacaucgaggauauugaacaguauaaaaaggcgaucacccagaagcuccaaacgucccugucucuuuuuaaauacgccaagaccaaaaauuugccacacauuaagccgaucuauaaauacauaacaauugaggggacugagaccgcugaaggaaucgagagcgccuacaucgaauccgagguccccgcacuggcugguacaucaauuggcuucaagauaaacagcaaagaagggaagcauuuacucgacguuaucgccuaugugaagagugcaucuuacuccagcguguauacuaaacuguacucgaccggaccuacgucaggcauuaauacaaagcacgaugagcuuugcaccgguccaugucccgccaacaucaaucaucagguaggguggcugacuuuugcucgugagcggacaucuaguuggggcugcgaagaguucggauguuuggcggucuccgacggcugcguguuugggagcugccaggauauuaucaaagaggaacucucuguuuaucgaaaggaaaccgaggaggugacugacgucgaacugugucuaaccuucagcgauaaaacauacugcacgaaccugaacccugugaccccaauaaucacugaccucuuugagguucaauucaagacaguggaaaccuauucccugcccagaauuguagccguccagaaucacgagaucaagauuggacagaucaacgaccuuggcguguacucaaaagguugugggaaugugcagaaggucaacggaacaauauacggcaaugguguuccgagguuugauuauuugugccaucuggcaagucgcaaagaggugauuguacggaaguguuucgacaacgauuaccaggcuugcaaauuuuuacagagcccugccucuuauagacucgaagaggacuccggcacugugaccaucaucgauuacaagaagauucuggggacgaucaaaaugaaggccauacuuggagacgucaaauauaagacauucgcugauucaguggacauuaccgcagaaggcaguuguacugggugcaucaauuguuucgagaacauucacugcgaacugacccuacacacaacuaucgaggccagcuguccaauaaaauccucuugcaccguuuuucaugauaggauucucgugacacccaaugagcacaaguacgcgcugaagauggucugcacggaaaaaccuggaaacaccuugacuaucaagguguguaauacaaaaguugaggcuucgauggcccugguggacgcaaagcccaucauugaauuagccccagucgaucagaccgcuuauauccgcgagaaagacgaacgaugcaagacuuggaugugucggguacgugacgagggccuccaggugauucuggagccuuucaagaaccuuuuugguagcuacauagggaucuucuacacauuuauuaucucaaucguugugcuguuggucauuauauaugugcuccugcccaucugcuucaaacuaagagauacccugaggaagcaugaagacgcauacaaacgcgagaugaagauucgguga

SEQ ID NO: 17115 - RNA, 708 nt, Artificial Sequence; identical to SEQ ID NO: 6846
  derived and/or modified CDS sequence (opt1) from LACV(Human/78)__NC_004110.1__N

SEQ ID NO: 17116 - RNA, 4326 nt, Artificial Sequence; identical to SEQ ID NO: 12653
  derived and/or modified CDS sequence (opt1) from LACV(Human/78)__NC_004109.1__GP

SEQ ID NO: 17117 - RNA, 4341 nt, Artificial Sequence
  derived and/or modified CDS sequence (opt1) from LACV(Human/78)__NC_004109.1__IgE-leader_Gn-NSm-Gc
auggacuggaccuggauccuguuccucguggccgccgcgacccgcguccacagcagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagacguacaacugccuggugcaguacaaggcgaaguggaugaugaacuuccucaucaucuacaucuuccugauccugaucaaggacuccgccaucgucgugcaggccgccggcaccgacuucacgaccugccucgagaccgagagcaucaacuggaacugcaccggccccuuccugaaccuggggaacugccagaagcagcagaagaaggagccguacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccgguga

SEQ ID NO: 17118 - RNA, 3696 nt, Artificial Sequence
  derived and/or modified CDS sequence (opt1) from LACV(Human/78)__NC_004109.1__SP-GP_Gn-4aa-Gc
augaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcuacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccgguga

SEQ ID NO: 17119 - RNA, 3711 nt, Artificial Sequence
  derived and/or modified CDS sequence (opt1) from LACV(Human/78)__NC_004109.1__IgE-leader_Gn-4aa-Gc
auggacuggaccuggauccuguuccucguggccgccgcgacccgcguccacagcagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcuacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccgguga

SEQ ID NO: 17120 - RNA, 708 nt, Artificial Sequence; identical to SEQ ID NO: 7538
  derived and/or modified CDS sequence (opt5) from LACV(Human/78)__NC_004109.1__N

SEQ ID NO: 17121 - RNA, 4326 nt, Artificial Sequence; identical to SEQ ID NO: 14296
  derived and/or modified CDS sequence (opt5) from LACV(Human/78)__NC_004109.1__GP

SEQ ID NO: 17122 - RNA, 4341 nt, Artificial Sequence
  derived and/or modified CDS sequence (opt5) from LACV(Human/78)__NC_004109.1__IgE-leader_Gn-NSm-Gc
auggacuggaccuggauccuguuccucguggccgcugcaacaagaguccacagcagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagagucaugugcaaauccaagggcccggccucuauccuuagcaucauuacggcugugcugguucucaccuucgugacacccaucaacuccaugguccugggggaaagcaaagagaccuuugagcuugaagaucugccugacgacaugcucgagauggccucucggauuaauuccuauuaccugacauguauccugaacuaugcugugagcuggggacucgucauuaucggccugcuuauuggccuccuguucaagaaguaccaacaccgcuuucugaauguguaugccauguacugcgaagagugugauauguaccacgacaaaucugggcuuaagagacauggagauuucaccaacaaaugccggcaguguacgugcggccaguaugaagacgccgcugggcugauggcgcaccgcaagacauacaauugccucguucaguauaaagccaaguggaugaugaacuuccugaucaucuacauuuuucugauccucauuaaggauagcgcuaucgugguccaagccgccggaaccgacuucaccacaugucuggagaccgaguccauuaacuggaauugcacaggccccuuucuuaaccuggggaauugucagaaacagcaaaagaaagaaccuuauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauugccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaaacuugcuaucucuuccaaaagcauuaagacauguaaaaaugugaaggacguugccugccugucuccucgcuccggcgccaucuaugcuagcauuaucgcguguggagaaccgaacggccccucugucuaccggaagccuagcgggggaguguuccaguccagcaccgauagaucuauuuauugccuccuggacucccauugccuggaggaguuugaagccaucggccaagaggaacuugaugcugugaaaaagagcaaauguugggagauugaguaccccgacgucaagcucauccaggaaggggacggaacaaaauccugccgcaugaaggauucuggcaauuguaacguggccaccaaucgguggccuguuauccagugcgagaacgacaaguucuacuauagcgaacugcagaaagauuacgacaaggcccaagauauugggcacuauugucugucccccggcugcaccacagugagauacccgaucaauccuaaacauauuucuaacuguaauuggcaggucagccgcuccucuaucgcuaagauugacgugcacaacaucgaggauaucgaacaguauaaaaaggccauuacgcagaagcuccaaaccagccugucccuuuuuaaauacgcgaagacaaagaaucugccccacaucaagccuauuuauaaauacaucaccauugagggaacagagaccgcugaaggcaucgagagcgccuacaucgaaucugagguucccgcccucgcugggacguccauuggauucaagaucaacagcaaagaaggcaagcaucugcuggacgugauugccuaugucaagucugcguccuacagcucuguguauacaaaacuuuacuccaccgggccuaccagcggaaucaauacaaagcacgaugagcucugcaccggccccuguccggcuaacauuaaucaucagguuggguggcugacauuugcccgggagagaacguccagcuggggcugcgaagaguucggaugucuggccgugucugacggcugcgucuuugggagcugccaggauaucauuaaagaggaacucuccguguaucgcaaggaaaccgaggaggugacagacgucgaacugugucuuaccuucucugauaaaacauacugcaccaaccugaacccuguuacgcccaucaucaccgaccucuuugaggugcaauucaagacaguggaaaccuauagccugccccggauugucgcugugcagaaucacgagaucaagauuggacagaucaacgaccugggcguuuacuccaaaggguguggaaaugugcagaaggucaacggcacaauuuacgggaauggcgugccuagauuugauuaucuuugccaucuggccucucggaaagagguuaucgugcgcaaguguuucgacaacgauuaccaggcuugcaaauuucuccaaagcccggccuccuauagacuggaagaggacucuggaaccgucacaaucauugauuacaagaagauccucggcaccauuaaaaugaaggcgauccugggggacgugaaauauaagacguucgccgauagcguugacauuacagcugaaggauccuguaccggcugcaucaauuguuucgagaacauccacugcgaacuuacccugcacacaaccauugaggccagcugucccaucaaaucuuccugcacgguguuucaugaucggauucucgucacaccuaaugagcacaaguacgcucugaagauggugugcaccgaaaaacccgggaacacacugaccaucaagguguguaauacaaaagucgaggccagcauggcccuuguugacgcuaagccuauuaucgaacuggcgcccguggaucagaccgccuauauuagagagaaagacgaacgcugcaagacguggaugugucgggugagagacgagggacuccaggucauccuggagccuuucaagaaccucuuuggcucuuacaucggcauuuucuacaccuuuaucauuuccaucgugguucugcuugugauuaucuauguccugcuccccaucugcuucaaacugcgcgauacacugagaaagcaugaagacgcuuacaaacgggagaugaagauucgcuga

SEQ ID NO: 17123 - RNA, 3696 nt, Artificial Sequence
  derived and/or modified CDS sequence (opt5) from LACV(Human/78)__NC_004109.1__SP-GP_Gn-4aa-Gc
augaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagauauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauugccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaaacuugcuaucucuuccaaaagcauuaagacauguaaaaaugugaaggacguugccugccugucuccucgcuccggcgccaucuaugcuagcauuaucgcguguggagaaccgaacggccccucugucuaccggaagccuagcgggggaguguuccaguccagcaccgauagaucuauuuauugccuccuggacucccauugccuggaggaguuugaagccaucggccaagaggaacuugaugcugugaaaaagagcaaauguugggagauugaguaccccgacgucaagcucauccaggaaggggacggaacaaaauccugccgcaugaaggauucuggcaauuguaacguggccaccaaucgguggccuguuauccagugcgagaacgacaaguucuacuauagcgaacugcagaaagauuacgacaaggcccaagauauugggcacuauugucugucccccggcugcaccacagugagauacccgaucaauccuaaacauauuucuaacuguaauuggcaggucagccgcuccucuaucgcuaagauugacgugcacaacaucgaggauaucgaacaguauaaaaaggccauuacgcagaagcuccaaaccagccugucccuuuuuaaauacgcgaagacaaagaaucugccccacaucaagccuauuuauaaauacaucaccauugagggaacagagaccgcugaaggcaucgagagcgccuacaucgaaucugagguucccgcccucgcugggacguccauuggauucaagaucaacagcaaagaaggcaagcaucugcuggacgugauugccuaugucaagucugcguccuacagcucuguguauacaaaacuuuacuccaccgggccuaccagcggaaucaauacaaagcacgaugagcucugcaccggccccuguccggcuaacauuaaucaucagguuggguggcugacauuugcccgggagagaacguccagcuggggcugcgaagaguucggaugucuggccgugucugacggcugcgucuuugggagcugccaggauaucauuaaagaggaacucuccguguaucgcaaggaaaccgaggaggugacagacgucgaacugugucuuaccuucucugauaaaacauacugcaccaaccugaacccuguuacgcccaucaucaccgaccucuuugaggugcaauucaagacaguggaaaccuauagccugccccggauugucgcugugcagaaucacgagaucaagauuggacagaucaacgaccugggcguuuacuccaaaggguguggaaaugugcagaaggucaacggcacaauuuacgggaauggcgugccuagauuugauuaucuuugccaucuggccucucggaaagagguuaucgugcgcaaguguuucgacaacgauuaccaggcuugcaaauuucuccaaagcccggccuccuauagacuggaagaggacucuggaaccgucacaaucauugauuacaagaagauccucggcaccauuaaaaugaaggcgauccugggggacgugaaauauaagacguucgccgauagcguugacauuacagcugaaggauccuguaccggcugcaucaauuguuucgagaacauccacugcgaacuuacccugcacacaaccauugaggccagcugucccaucaaaucuuccugcacgguguuucaugaucggauucucgucacaccuaaugagcacaaguacgcucugaagauggugugcaccgaaaaacccgggaacacacugaccaucaagguguguaauacaaaagucgaggccagcauggcccuuguugacgcuaagccuauuaucgaacuggcgcccguggaucagaccgccuauauuagagagaaagacgaacgcugcaagacguggaugugucgggugagagacgagggacuccaggucauccuggagccuuucaagaaccucuuuggcucuuacaucggcauuuucuacaccuuuaucauuuccaucgugguucugcuugugauuaucuauguccugcuccccaucugcuucaaacugcgcgauacacugagaaagcaugaagacgcuuacaaacgggagaugaagauucgcuga

SEQ ID NO: 17124 - RNA, 3711 nt, Artificial Sequence
  derived and/or modified CDS sequence (opt5) from LACV(Human/78)__NC_004109.1__IgE-leader_Gn-4aa-Gc
auggacuggaccuggauccuguuccucguggccgcugcaacaagaguccacagcagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagauauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauugccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaaacuugcuaucucuuccaaaagcauuaagacauguaaaaaugugaaggacguugccugccugucuccucgcuccggcgccaucuaugcuagcauuaucgcguguggagaaccgaacggccccucugucuaccggaagccuagcgggggaguguuccaguccagcaccgauagaucuauuuauugccuccuggacucccauugccuggaggaguuugaagccaucggccaagaggaacuugaugcugugaaaaagagcaaauguugggagauugaguaccccgacgucaagcucauccaggaaggggacggaacaaaauccugccgcaugaaggauucuggcaauuguaacguggccaccaaucgguggccuguuauccagugcgagaacgacaaguucuacuauagcgaacugcagaaagauuacgacaaggcccaagauauugggcacuauugucugucccccggcugcaccacagugagauacccgaucaauccuaaacauauuucuaacuguaauuggcaggucagccgcuccucuaucgcuaagauugacgugcacaacaucgaggauaucgaacaguauaaaaaggccauuacgcagaagcuccaaaccagccugucccuuuuuaaauacgcgaagacaaagaaucugccccacaucaagccuauuuauaaauacaucaccauugagggaacagagaccgcugaaggcaucgagagcgccuacaucgaaucugagguucccgcccucgcugggacguccauuggauucaagaucaacagcaaagaaggcaagcaucugcuggacgugauugccuaugucaagucugcguccuacagcucuguguauacaaaacuuuacuccaccgggccuaccagcggaaucaauacaaagcacgaugagcucugcaccggccccuguccggcuaacauuaaucaucagguuggguggcugacauuugcccgggagagaacguccagcuggggcugcgaagaguucggaugucuggccgugucugacggcugcgucuuugggagcugccaggauaucauuaaagaggaacucuccguguaucgcaaggaaaccgaggaggugacagacgucgaacugugucuuaccuucucugauaaaacauacugcaccaaccugaacccuguuacgcccaucaucaccgaccucuuugaggugcaauucaagacaguggaaaccuauagccugccccggauugucgcugugcagaaucacgagaucaagauuggacagaucaacgaccugggcguuuacuccaaaggguguggaaaugugcagaaggucaacggcacaauuuacgggaauggcgugccuagauuugauuaucuuugccaucuggccucucggaaagagguuaucgugcgcaaguguuucgacaacgauuaccaggcuugcaaauuucuccaaagcccggccuccuauagacuggaagaggacucuggaaccgucacaaucauugauuacaagaagauccucggcaccauuaaaaugaaggcgauccugggggacgugaaauauaagacguucgccgauagcguugacauuacagcugaaggauccuguaccggcugcaucaauuguuucgagaacauccacugcgaacuuacccugcacacaaccauugaggccagcugucccaucaaaucuuccugcacgguguuucaugaucggauucucgucacaccuaaugagcacaaguacgcucugaagauggugugcaccgaaaaacccgggaacacacugaccaucaagguguguaauacaaaagucgaggccagcauggcccuuguugacgcuaagccuauuaucgaacuggcgcccguggaucagaccgccuauauuagagagaaagacgaacgcugcaagacguggaugugucgggugagagacgagggacuccaggucauccuggagccuuucaagaaccucuuuggcucuuacaucggcauuuucuacaccuuuaucauuuccaucgugguucugcuugugauuaucuauguccugcuccccaucugcuucaaacugcgcgauacacugagaaagcaugaagacgcuuacaaacgggagaugaagauucgcuga

SEQ ID NO: 17125 - RNA, 708 nt, Artificial Sequence; identical to SEQ ID NO: 8230
  derived and/or modified CDS sequence (opt11) from LACV(Human/78)__NC_004109.1__N

SEQ ID NO: 17126 - RNA, 4326 nt, Artificial Sequence; identical to SEQ ID NO: 12653
  derived and/or modified CDS sequence (opt11) from LACV(Human/78)__NC_004109.1__GP

SEQ ID NO: 17127 - RNA, 4341 nt, Artificial Sequence
  derived and/or modified CDS sequence (opt11) from LACV(Human/78)__NC_004109.1__IgE-leader_Gn-NSm-Gc
auggacuggaccuggauccuguuccucguggccgcugcaacaagaguccacagcagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagacguacaacugccuggugcaguacaaggcgaaguggaugaugaacuuccucaucaucuacaucuuccugauccugaucaaggacuccgccaucgucgugcaggccgccggcaccgacuucacgaccugccucgagaccgagagcaucaacuggaacugcaccggccccuuccugaaccuggggaacugccagaagcagcagaagaaggagccguacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccgguga

SEQ ID NO: 17128 - RNA, 3696 nt, Artificial Sequence; identical to SEQ ID NO: 17118
  derived and/or modified CDS sequence (opt11) from LACV(Human/78)__NC_004109.1__SP-GP_Gn-4aa-Gc

SEQ ID NO: 17129 - RNA, 3711 nt, Artificial Sequence
  derived and/or modified CDS sequence (opt11) from LACV(Human/78)__NC_004109.1__IgE-leader_Gn-4aa-Gc
auggacuggaccuggauccuguuccucguggccgcugcaacaagaguccacagcagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcuacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccgguga

SEQ ID NO: 17130 - RNA, 925 nt, Artificial Sequence
  mRNA product Design1 comprising derived and/or modified sequence from LACV(Human/78)__NC_004109.1__N (wt)
gggagaaagcuuaccaugucggauuugguguuuuaugaugucgcaucaacaggugcaaauggauuugauccugaugcaggguauauggacuucuguguuaaaaaugcagaauuacucaaccuugcugcaguuaggaucuucuuccucaaugccgcaaaggccaaggcugcucucucgcguaagccagagaggaaggcuaacccuaaauuuggagaguggcagguggagguuaucaauaaucauuuuccuggaaacaggaacaacccaauugguaacaacgaucuuaccauccacagauuaucuggguauuuagccagauggguccuugaucaguauaacgagaaugaugaugagucucagcacgaguugaucagaacaacuauuaucaacccaauugcugagucuaaugguguaggaugggacagugggccagagaucuaucuaucauucuuuccaggaacagaaauguuuuuggaaacuuucaaauucuacccgcugaccauuggaauucacagagucaagcaaggcaugauggacccucaauaccugaagaaggccuuaaggcaacgcuauggcacucucacagcagauaaguggaugucacagaagguugcagcaauugcuaagagccugaaggauguagagcagcuuaaauggggaaaaggaggccugagcgauacugcuaaaacauuccugcagaaauuuggcaucaggcuuccauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17131 - RNA, 925 nt, Artificial Sequence
  mRNA product Design1 comprising derived and/or modified sequence from LACV(Human/78)__NC_004109.1__N (wt)
gggagaaagcuuaccaugucggauuugguguuuuaugaugucgcaucaacaggugcaaauggauuugauccugaugcaggguauauggacuucuguguuaaaaaugcagaauuacucaaccuugcugcaguuaggaucuucuuccucaaugccgcaaaggccaaggcugcucucucgcguaagccagagaggaaggcuaacccuaaauuuggagaguggcaggucgagguuaucaauaaucauuuuccuggaaacaggaacaacccaauugguaacaacgaucuuaccauccacagauuaucuggguauuuagccagauggguccuugaucaguauaacgagaaugaugaugagucucagcacgaguugaucagaacaacuauuaucaacccaauugcugagucuaaugguguaggaugggacagugggccagagaucuaucuaucauucuuuccaggaacagaaauguuuuuggaaacuuucaaauucuacccgcugaccauuggaauccacagagucaagcaaggcaugauggacccucaauaccugaagaaggccuuaaggcaacgcuauggcacucucacagcagauaaguggaugucacagaagguugcagcaauugcuaagagccugaaggauguagagcagcuuaaauggggaaaaggaggccugagcgauacugcuaaaacauuccugcagaaauuuggcaucaggcuuccauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17132 - RNA, 4543 nt, Artificial Sequence
  mRNA product Design1 comprising derived and/or modified sequence from LACV(Human/78)__NC_004109.1__GP (wt)
gggagaaagcuuaccaugauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17133 - RNA, 4543 nt, Artificial Sequence
  mRNA product Design1 comprising derived and/or modified sequence from LACV(Human/78)__NC_004109.1__GP (wt)
gggagaaagcuuaccaugauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaguucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17134 - RNA, 4558 nt, Artificial Sequence
  mRNA product Design1 comprising derived and/or modified sequence from LACV(Human/78)__NC_004109.1__IgE-leader_Gn-NSm-Gc (wt)
gggagaaagcuuaccauggacuggaccuggauccuguuccucguggccgccgcgacccgcguccacagcagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17135 - RNA, 4558 nt, Artificial Sequence
  mRNA product Design1 comprising derived and/or modified sequence from LACV(Human/78)__NC_004109.1__IgE-leader_Gn-NSm-Gc (wt)
gggagaaagcuuaccauggacuggaccuggauccuguuccucguggccgccgcgacccgcguccacagcagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaguucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17136 - RNA, 3913 nt, Artificial Sequence
  mRNA product Design1 comprising derived and/or modified sequence from LACV(Human/78)__NC_004109.1__SP-GP_Gn-4aa-Gc (wt)
gggagaaagcuuaccaugauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagauacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17137 - RNA, 3913 nt, Artificial Sequence
  mRNA product Design1 comprising derived and/or modified sequence from LACV(Human/78)__NC_004109.1__SP-GP_Gn-4aa-Gc (wt)
gggagaaagcuuaccaugauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagauacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaguucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17138 - RNA, 3928 nt, Artificial Sequence
  mRNA product Design1 comprising derived and/or modified sequence from LACV(Human/78)__NC_004109.1__IgE-leader_Gn-4aa-Gc (wt)
gggagaaagcuuaccauggacuggaccuggauccuguuccucguggccgccgcgacccgcguccacagcagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagauacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17139 - RNA, 3928 nt, Artificial Sequence
  mRNA product Design1 comprising derived and/or modified sequence from LACV(Human/78)__NC_004109.1__IgE-leader_Gn-4aa-Gc (wt)
gggagaaagcuuaccauggacuggaccuggauccuguuccucguggccgccgcgacccgcguccacagcagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagauacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaguucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17140 - RNA, 925 nt, Artificial Sequence
  mRNA product Design1 comprising derived and/or modified sequence from LACV(Human/78)__NC_004109.1__N (opt4)
gggagaaagcuuaccaugagcgaccugguguucuacgacguggccagcaccggcgccaacggcuucgaccccgacgccggcuacauggacuucugcgugaagaacgccgagcugcugaaccuggccgccgugagaaucuucuuccugaacgccgccaaggccaaggccgcccugagcagaaagcccgagagaaaggccaaccccaaguucggcgaguggcagguggaggugaucaacaaccacuuccccggcaacagaaacaaccccaucggcaacaacgaccugaccauccacagacugagcggcuaccuggccagaugggugcuggaccaguacaacgagaacgacgacgagagccagcacgagcugaucagaaccaccaucaucaaccccaucgccgagagcaacggcgugggcugggacagcggccccgagaucuaccugagcuucuuccccggcaccgagauguuccuggagaccuucaaguucuacccccugaccaucggcauccacagagugaagcagggcaugauggacccccaguaccugaagaaggcccugagacagagauacggcacccugaccgccgacaaguggaugagccagaagguggccgccaucgccaagagccugaaggacguggagcagcugaaguggggcaagggcggccugagcgacaccgccaagaccuuccugcagaaguucggcaucagacugcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17141 - RNA, 4543 nt, Artificial Sequence
  mRNA product Design1 comprising derived and/or modified sequence from LACV(Human/78)__NC_004109.1__GP (opt4)
gggagaaagcuuaccaugaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaaggcccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagguggaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggugcugcuggugaucaucuacgugcugcugcccaucugcuucaagcugagagacacccugagaaagcacgaggacgccuacaagagagagaugaagaucagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17142 - RNA, 4558 nt, Artificial Sequence
  mRNA product Design1 comprising derived and/or modified sequence from LACV(Human/78)__NC_004109.1__IgE-leader_Gn-NSm-Gc (opt4)
gggagaaagcuuaccauggacuggaccuggauccuguuccucguggccgcugcaacaagaguccacagcagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaaggcccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagguggaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggugcugcuggugaucaucuacgugcugcugcccaucugcuucaagcugagagacacccugagaaagcacgaggacgccuacaagagagagaugaagaucagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17143 - RNA, 3913 nt, Artificial Sequence
  mRNA product Design1 comprising derived and/or modified sequence from LACV(Human/78)__NC_004109.1__SP-GP_Gn-4aa-Gc (opt4)
gggagaaagcuuaccaugaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagauacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaaggcccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagguggaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggugcugcuggugaucaucuacgugcugcugcccaucugcuucaagcugagagacacccugagaaagcacgaggacgccuacaagagagagaugaagaucagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17144 - RNA, 3928 nt, Artificial Sequence
  mRNA product Design1 comprising derived and/or modified sequence from LACV(Human/78)__NC_004109.1__IgE-leader_Gn-4aa-Gc (opt4)
gggagaaagcuuaccauggacuggaccuggauccuguuccucguggccgcugcaacaagaguccacagcagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagauacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaaggcccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagguggaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggugcugcuggugaucaucuacgugcugcugcccaucugcuucaagcugagagacacccugagaaagcacgaggacgccuacaagagagagaugaagaucagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17145 - RNA, 925 nt, Artificial Sequence
  mRNA product Design1 comprising derived and/or modified sequence from LACV(Human/78)__NC_004109.1__N (opt3)
gggagaaagcuuaccaugagcgaccugguguucuacgaugucgccuccaccggcgcuaacggguuugaccccgaugcaggauauauggacuucugcguuaagaaugccgagcuccuuaaccuggcggcugugagaaucuuuuucuugaaugccgcaaaagccaaggcugcauuaucuaggaaaccugaacggaaggccaacccaaaauuuggugaguggcagguagaagugauuaauaaccacuucccgggcaaucgcaacaaucccauagggaacaaugaucugacaauccaucgacuaucaggauaccucgcucguuggguccuggaccaauauaacgagaaugaugacgaaagucagcacgagcuuauuagaacuacgaucauuaacccuaucgccgagagcaauggcguggguugggauuccgggccagaaauauaccugucguuuuuccccggaaccgagauguuuuuggaaacauucaaguuuuauccucucacuaucggcauucauaggguuaagcagggcaugauggacccacaguaccugaaaaaggcgcugcggcaacgcuaugggacccucacagcagauaaauggaugucucagaagguggccgcuaucgccaaaucauuaaaggacgucgagcagcugaaguggggaaaagguggccuuagcgauaccgcaaagacuuucuugcagaaauuugggauuagacugcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17146 - RNA, 4543 nt, Artificial Sequence
  mRNA product Design1 comprising derived and/or modified sequence from LACV(Human/78)__NC_004109.1__GP (opt3)
gggagaaagcuuaccaugaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgggugaugugcaaaucaaagggcccagccagcauucuuaguaucauuacagcaguucugguguugaccuucgucacucccauaaacucuauggugcucggggaauccaaagagacauuugagcuggaagauuuaccugacgacaugcuggagauggcuagccgcaucaauucguauuaccucaccuguauucuuaacuaugccguaucuuggggacugguuaucaucggcuugcuaauuggucugcucuuuaagaaguaccaacaccgauuucugaauguguaugcgauguacugcgaagagugugauauguaccacgacaaauccgggcuuaagagacauggagauuucacgaacaaaugcaggcaguguaccugcggccaguaugaagacgccgcaggccugauggcucaccggaagacauacaauugcuugguccaguauaaagccaaguggaugaugaacuuccucauaaucuacauuuuucugaucuuaauuaaggauucagcuaucgugguccaagccgcagggacugacuucaccacaugucuggagacugagaguauaaacuggaauugcaccggaccauuucuaaaccucgguaauugucagaaacagcaaaagaaagaaccguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacgacuucgaggcuuguauucuguacccaaaccagcauuuuuguaggugcgucaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauaucgcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaaaaugugaaggacguugccugcuuauccccgcgcucaggagcgauuuaugccagcaucaucgcuuguggugaaccuaacggccccucuguguacagaaagccauccgggggagucuuccagaguagcacugauaggucuauuuauugccugcuugacucccauugcuuggaggaguuugaagcaaucggccaagaggaacucgaugccgugaaaaagucaaaauguugggagauugaguacccugacguaaagcugauacaggaaggugacgggacaaaaaguugccggaugaaggauagcggcaauuguaacguggcuaccaaucgcuggcccguuauccagugcgagaacgacaaguucuacuauucggaacuacagaaagauuacgacaaggcccaagauauuggacacuauugucuguccccaggcugcacaacugucagauaccccaucaauccuaaacauauuucuaacuguaauuggcaagugagcaggucaaguaucgcaaagauagacgugcacaacaucgaggauauugaacaguauaaaaaggcgaucacccagaagcuccaaacgucccugucucuuuuuaaauacgccaagaccaaaaauuugccacacauuaagccgaucuauaaauacauaacaauugaggggacugagaccgcugaaggaaucgagagcgccuacaucgaauccgagguccccgcacuggcugguacaucaauuggcuucaagauaaacagcaaagaagggaagcauuuacucgacguuaucgccuaugugaagagugcaucuuacuccagcguguauacuaaacuguacucgaccggaccuacgucaggcauuaauacaaagcacgaugagcuuugcaccgguccaugucccgccaacaucaaucaucagguaggguggcugacuuuugcucgugagcggacaucuaguuggggcugcgaagaguucggauguuuggcggucuccgacggcugcguguuugggagcugccaggauauuaucaaagaggaacucucuguuuaucgaaaggaaaccgaggaggugacugacgucgaacugugucuaaccuucagcgauaaaacauacugcacgaaccugaacccugugaccccaauaaucacugaccucuuugagguucaauucaagacaguggaaaccuauucccugcccagaauuguagccguccagaaucacgagaucaagauuggacagaucaacgaccuuggcguguacucaaaagguugugggaaugugcagaaggucaacggaacaauauacggcaaugguguuccgagguuugauuauuugugccaucuggcaagucgcaaagaggugauuguacggaaguguuucgacaacgauuaccaggcuugcaaauuuuuacagagcccugccucuuauagacucgaagaggacuccggcacugugaccaucaucgauuacaagaagauucuggggacgaucaaaaugaaggccauacuuggagacgucaaauauaagacauucgcugauucaguggacauuaccgcagaaggcaguuguacugggugcaucaauuguuucgagaacauucacugcgaacugacccuacacacaacuaucgaggccagcuguccaauaaaauccucuugcaccguuuuucaugauaggauucucgugacacccaaugagcacaaguacgcgcugaagauggucugcacggaaaaaccuggaaacaccuugacuaucaagguguguaauacaaaaguugaggcuucgauggcccugguggacgcaaagcccaucauugaauuagccccagucgaucagaccgcuuauauccgcgagaaagacgaacgaugcaagacuuggaugugucggguacgugacgagggccuccaggugauucuggagccuuucaagaaccuuuuugguagcuacauagggaucuucuacacauuuauuaucucaaucguugugcuguuggucauuauauaugugcuccugcccaucugcuucaaacuaagagauacccugaggaagcaugaagacgcauacaaacgcgagaugaagauucggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17147 - RNA, 4558 nt, Artificial Sequence
  mRNA product Design1 comprising derived and/or modified sequence from LACV(Human/78)__NC_004109.1__IgE-leader_Gn-NSm-Gc (opt3)
gggagaaagcuuaccauggacuggaccuggauccuguuccucguggccgcugcaacaagaguccacagcagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgggugaugugcaaaucaaagggcccagccagcauucuuaguaucauuacagcaguucugguguugaccuucgucacucccauaaacucuauggugcucggggaauccaaagagacauuugagcuggaagauuuaccugacgacaugcuggagauggcuagccgcaucaauucguauuaccucaccuguauucuuaacuaugccguaucuuggggacugguuaucaucggcuugcuaauuggucugcucuuuaagaaguaccaacaccgauuucugaauguguaugcgauguacugcgaagagugugauauguaccacgacaaauccgggcuuaagagacauggagauuucacgaacaaaugcaggcaguguaccugcggccaguaugaagacgccgcaggccugauggcucaccggaagacauacaauugcuugguccaguauaaagccaaguggaugaugaacuuccucauaaucuacauuuuucugaucuuaauuaaggauucagcuaucgugguccaagccgcagggacugacuucaccacaugucuggagacugagaguauaaacuggaauugcaccggaccauuucuaaaccucgguaauugucagaaacagcaaaagaaagaaccguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacgacuucgaggcuuguauucuguacccaaaccagcauuuuuguaggugcgucaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauaucgcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaaaaugugaaggacguugccugcuuauccccgcgcucaggagcgauuuaugccagcaucaucgcuuguggugaaccuaacggccccucuguguacagaaagccauccgggggagucuuccagaguagcacugauaggucuauuuauugccugcuugacucccauugcuuggaggaguuugaagcaaucggccaagaggaacucgaugccgugaaaaagucaaaauguugggagauugaguacccugacguaaagcugauacaggaaggugacgggacaaaaaguugccggaugaaggauagcggcaauuguaacguggcuaccaaucgcuggcccguuauccagugcgagaacgacaaguucuacuauucggaacuacagaaagauuacgacaaggcccaagauauuggacacuauugucuguccccaggcugcacaacugucagauaccccaucaauccuaaacauauuucuaacuguaauuggcaagugagcaggucaaguaucgcaaagauagacgugcacaacaucgaggauauugaacaguauaaaaaggcgaucacccagaagcuccaaacgucccugucucuuuuuaaauacgccaagaccaaaaauuugccacacauuaagccgaucuauaaauacauaacaauugaggggacugagaccgcugaaggaaucgagagcgccuacaucgaauccgagguccccgcacuggcugguacaucaauuggcuucaagauaaacagcaaagaagggaagcauuuacucgacguuaucgccuaugugaagagugcaucuuacuccagcguguauacuaaacuguacucgaccggaccuacgucaggcauuaauacaaagcacgaugagcuuugcaccgguccaugucccgccaacaucaaucaucagguaggguggcugacuuuugcucgugagcggacaucuaguuggggcugcgaagaguucggauguuuggcggucuccgacggcugcguguuugggagcugccaggauauuaucaaagaggaacucucuguuuaucgaaaggaaaccgaggaggugacugacgucgaacugugucuaaccuucagcgauaaaacauacugcacgaaccugaacccugugaccccaauaaucacugaccucuuugagguucaauucaagacaguggaaaccuauucccugcccagaauuguagccguccagaaucacgagaucaagauuggacagaucaacgaccuuggcguguacucaaaagguugugggaaugugcagaaggucaacggaacaauauacggcaaugguguuccgagguuugauuauuugugccaucuggcaagucgcaaagaggugauuguacggaaguguuucgacaacgauuaccaggcuugcaaauuuuuacagagcccugccucuuauagacucgaagaggacuccggcacugugaccaucaucgauuacaagaagauucuggggacgaucaaaaugaaggccauacuuggagacgucaaauauaagacauucgcugauucaguggacauuaccgcagaaggcaguuguacugggugcaucaauuguuucgagaacauucacugcgaacugacccuacacacaacuaucgaggccagcuguccaauaaaauccucuugcaccguuuuucaugauaggauucucgugacacccaaugagcacaaguacgcgcugaagauggucugcacggaaaaaccuggaaacaccuugacuaucaagguguguaauacaaaaguugaggcuucgauggcccugguggacgcaaagcccaucauugaauuagccccagucgaucagaccgcuuauauccgcgagaaagacgaacgaugcaagacuuggaugugucggguacgugacgagggccuccaggugauucuggagccuuucaagaaccuuuuugguagcuacauagggaucuucuacacauuuauuaucucaaucguugugcuguuggucauuauauaugugcuccugcccaucugcuucaaacuaagagauacccugaggaagcaugaagacgcauacaaacgcgagaugaagauucggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17148 - RNA, 3913 nt, Artificial Sequence
  mRNA product Design1 comprising derived and/or modified sequence from LACV(Human/78)__NC_004109.1__SP-GP_Gn-4aa-Gc (opt3)
gggagaaagcuuaccaugaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacgacuucgaggcuuguauucuguacccaaaccagcauuuuuguaggugcgucaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauaucgcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaaaaugugaaggacguugccugcuuauccccgcgcucaggagcgauuuaugccagcaucaucgcuuguggugaaccuaacggccccucuguguacagaaagccauccgggggagucuuccagaguagcacugauaggucuauuuauugccugcuugacucccauugcuuggaggaguuugaagcaaucggccaagaggaacucgaugccgugaaaaagucaaaauguugggagauugaguacccugacguaaagcugauacaggaaggugacgggacaaaaaguugccggaugaaggauagcggcaauuguaacguggcuaccaaucgcuggcccguuauccagugcgagaacgacaaguucuacuauucggaacuacagaaagauuacgacaaggcccaagauauuggacacuauugucuguccccaggcugcacaacugucagauaccccaucaauccuaaacauauuucuaacuguaauuggcaagugagcaggucaaguaucgcaaagauagacgugcacaacaucgaggauauugaacaguauaaaaaggcgaucacccagaagcuccaaacgucccugucucuuuuuaaauacgccaagaccaaaaauuugccacacauuaagccgaucuauaaauacauaacaauugaggggacugagaccgcugaaggaaucgagagcgccuacaucgaauccgagguccccgcacuggcugguacaucaauuggcuucaagauaaacagcaaagaagggaagcauuuacucgacguuaucgccuaugugaagagugcaucuuacuccagcguguauacuaaacuguacucgaccggaccuacgucaggcauuaauacaaagcacgaugagcuuugcaccgguccaugucccgccaacaucaaucaucagguaggguggcugacuuuugcucgugagcggacaucuaguuggggcugcgaagaguucggauguuuggcggucuccgacggcugcguguuugggagcugccaggauauuaucaaagaggaacucucuguuuaucgaaaggaaaccgaggaggugacugacgucgaacugugucuaaccuucagcgauaaaacauacugcacgaaccugaacccugugaccccaauaaucacugaccucuuugagguucaauucaagacaguggaaaccuauucccugcccagaauuguagccguccagaaucacgagaucaagauuggacagaucaacgaccuuggcguguacucaaaagguugugggaaugugcagaaggucaacggaacaauauacggcaaugguguuccgagguuugauuauuugugccaucuggcaagucgcaaagaggugauuguacggaaguguuucgacaacgauuaccaggcuugcaaauuuuuacagagcccugccucuuauagacucgaagaggacuccggcacugugaccaucaucgauuacaagaagauucuggggacgaucaaaaugaaggccauacuuggagacgucaaauauaagacauucgcugauucaguggacauuaccgcagaaggcaguuguacugggugcaucaauuguuucgagaacauucacugcgaacugacccuacacacaacuaucgaggccagcuguccaauaaaauccucuugcaccguuuuucaugauaggauucucgugacacccaaugagcacaaguacgcgcugaagauggucugcacggaaaaaccuggaaacaccuugacuaucaagguguguaauacaaaaguugaggcuucgauggcccugguggacgcaaagcccaucauugaauuagccccagucgaucagaccgcuuauauccgcgagaaagacgaacgaugcaagacuuggaugugucggguacgugacgagggccuccaggugauucuggagccuuucaagaaccuuuuugguagcuacauagggaucuucuacacauuuauuaucucaaucguugugcuguuggucauuauauaugugcuccugcccaucugcuucaaacuaagagauacccugaggaagcaugaagacgcauacaaacgcgagaugaagauucggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17149 - RNA, 3928 nt, Artificial Sequence
  mRNA product Design1 comprising derived and/or modified sequence from LACV(Human/78)__NC_004109.1__IgE-leader_Gn-4aa-Gc (opt3)
gggagaaagcuuaccauggacuggaccuggauccuguuccucguggccgcugcaacaagaguccacagcagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacgacuucgaggcuuguauucuguacccaaaccagcauuuuuguaggugcgucaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauaucgcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaaaaugugaaggacguugccugcuuauccccgcgcucaggagcgauuuaugccagcaucaucgcuuguggugaaccuaacggccccucuguguacagaaagccauccgggggagucuuccagaguagcacugauaggucuauuuauugccugcuugacucccauugcuuggaggaguuugaagcaaucggccaagaggaacucgaugccgugaaaaagucaaaauguugggagauugaguacccugacguaaagcugauacaggaaggugacgggacaaaaaguugccggaugaaggauagcggcaauuguaacguggcuaccaaucgcuggcccguuauccagugcgagaacgacaaguucuacuauucggaacuacagaaagauuacgacaaggcccaagauauuggacacuauugucuguccccaggcugcacaacugucagauaccccaucaauccuaaacauauuucuaacuguaauuggcaagugagcaggucaaguaucgcaaagauagacgugcacaacaucgaggauauugaacaguauaaaaaggcgaucacccagaagcuccaaacgucccugucucuuuuuaaauacgccaagaccaaaaauuugccacacauuaagccgaucuauaaauacauaacaauugaggggacugagaccgcugaaggaaucgagagcgccuacaucgaauccgagguccccgcacuggcugguacaucaauuggcuucaagauaaacagcaaagaagggaagcauuuacucgacguuaucgccuaugugaagagugcaucuuacuccagcguguauacuaaacuguacucgaccggaccuacgucaggcauuaauacaaagcacgaugagcuuugcaccgguccaugucccgccaacaucaaucaucagguaggguggcugacuuuugcucgugagcggacaucuaguuggggcugcgaagaguucggauguuuggcggucuccgacggcugcguguuugggagcugccaggauauuaucaaagaggaacucucuguuuaucgaaaggaaaccgaggaggugacugacgucgaacugugucuaaccuucagcgauaaaacauacugcacgaaccugaacccugugaccccaauaaucacugaccucuuugagguucaauucaagacaguggaaaccuauucccugcccagaauuguagccguccagaaucacgagaucaagauuggacagaucaacgaccuuggcguguacucaaaagguugugggaaugugcagaaggucaacggaacaauauacggcaaugguguuccgagguuugauuauuugugccaucuggcaagucgcaaagaggugauuguacggaaguguuucgacaacgauuaccaggcuugcaaauuuuuacagagcccugccucuuauagacucgaagaggacuccggcacugugaccaucaucgauuacaagaagauucuggggacgaucaaaaugaaggccauacuuggagacgucaaauauaagacauucgcugauucaguggacauuaccgcagaaggcaguuguacugggugcaucaauuguuucgagaacauucacugcgaacugacccuacacacaacuaucgaggccagcuguccaauaaaauccucuugcaccguuuuucaugauaggauucucgugacacccaaugagcacaaguacgcgcugaagauggucugcacggaaaaaccuggaaacaccuugacuaucaagguguguaauacaaaaguugaggcuucgauggcccugguggacgcaaagcccaucauugaauuagccccagucgaucagaccgcuuauauccgcgagaaagacgaacgaugcaagacuuggaugugucggguacgugacgagggccuccaggugauucuggagccuuucaagaaccuuuuugguagcuacauagggaucuucuacacauuuauuaucucaaucguugugcuguuggucauuauauaugugcuccugcccaucugcuucaaacuaagagauacccugaggaagcaugaagacgcauacaaacgcgagaugaagauucggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17150 - RNA, 925 nt, Artificial Sequence
  mRNA product Design1 comprising derived and/or modified sequence from LACV(Human/78)__NC_004110.1__N (opt1)
gggagaaagcuuaccaugagcgaccugguguucuacgacgucgccuccaccggcgccaacggguucgaccccgacgcgggcuacauggacuucugcgugaagaacgccgagcuccugaaccuggccgccgugcgcaucuucuuccucaacgccgcgaaggccaaggccgcccugagccggaagccggagcgcaaggcgaaccccaaguucggggaguggcaggucgaggugaucaacaaccacuuccccggcaaccggaacaaccccaucgggaacaacgaccugaccauccaccgccucuccggcuaccuggcccggugggugcuggaccaguacaacgagaacgacgacgagagccagcacgagcucauccgcacgaccaucaucaacccgaucgccgaguccaacggcgucgggugggacagcggccccgagaucuaccuguccuucuuccccgggaccgagauguuccuggagaccuucaaguucuacccccucacgaucggcauccaccgggugaagcaggggaugauggacccgcaguaccugaagaaggcccugcgccagcgguacggcacccucaccgccgacaaguggaugagccagaagguggcggccaucgccaagucccugaaggacgucgagcagcugaaguggggcaagggcgggcucagcgacaccgccaagacguuccugcagaaguucgggauccgccugcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17151 - RNA, 4543 nt, Artificial Sequence
  mRNA product Design1 comprising derived and/or modified sequence from LACV(Human/78)__NC_004109.1__GP (opt1)
gggagaaagcuuaccaugaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagacguacaacugccuggugcaguacaaggcgaaguggaugaugaacuuccucaucaucuacaucuuccugauccugaucaaggacuccgccaucgucgugcaggccgccggcaccgacuucacgaccugccucgagaccgagagcaucaacuggaacugcaccggccccuuccugaaccuggggaacugccagaagcagcagaagaaggagccguacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17152 - RNA, 4558 nt, Artificial Sequence
  mRNA product Design1 comprising derived and/or modified sequence from LACV(Human/78)__NC_004109.1__IgE-leader_Gn-NSm-Gc (opt1)
gggagaaagcuuaccauggacuggaccuggauccuguuccucguggccgccgcgacccgcguccacagcagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagacguacaacugccuggugcaguacaaggcgaaguggaugaugaacuuccucaucaucuacaucuuccugauccugaucaaggacuccgccaucgucgugcaggccgccggcaccgacuucacgaccugccucgagaccgagagcaucaacuggaacugcaccggccccuuccugaaccuggggaacugccagaagcagcagaagaaggagccguacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17153 - RNA, 3913 nt, Artificial Sequence
  mRNA product Design1 comprising derived and/or modified sequence from LACV(Human/78)__NC_004109.1__SP-GP_Gn-4aa-Gc (opt1)
gggagaaagcuuaccaugaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcuacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17154 - RNA, 3928 nt, Artificial Sequence
  mRNA product Design1 comprising derived and/or modified sequence from LACV(Human/78)__NC_004109.1__IgE-leader_Gn-4aa-Gc (opt1)
gggagaaagcuuaccauggacuggaccuggauccuguuccucguggccgccgcgacccgcguccacagcagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcuacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17155 - RNA, 925 nt, Artificial Sequence
  mRNA product Design1 comprising derived and/or modified sequence from LACV(Human/78)__NC_004109.1__N (opt5)
gggagaaagcuuaccaugagcgaccugguguucuacgaugucgccuccaccggcgcuaacggguuugaccccgaugccggauauauggacuucugcguuaagaaugcggagcuccugaaccuugcugccgugagaaucuuuuuccugaaugccgcuaaagccaaggcugcccucucucggaaaccugaacgcaaggcgaacccgaaauuuggcgaguggcaaguggaagucauuaauaaccacuuccccgggaauagaaacaauccuaucggaaacaaugaucugacaauucaucggcuuagcggcuaccuggcccgcugggugcucgaccaguauaacgagaaugaugacgaaucccagcacgagcugaucagaacgaccauuaucaaccccaucgcugagucuaaugggguuggaugggauagcggcccugaaauuuaccuguccuuuuuccccggcacagagauguuucucgaaaccuucaaguuuuauccucugacaaucgggauucaucgggugaagcagggaaugauggacccgcaguaccuuaaaaaggcccugcgccaaagauauggcacccucacagcugauaaauggaugucucagaaggucgccgcgaucgccaaaagccugaaggacguggagcagcuuaagugggggaaaggaggccuguccgauaccgcuaagacguuccuccagaaauuugggauucggcugcccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17156 - RNA, 4543 nt, Artificial Sequence
  mRNA product Design1 comprising derived and/or modified sequence from LACV(Human/78)__NC_004109.1__GP (opt5)
gggagaaagcuuaccaugaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagagucaugugcaaauccaagggcccggccucuauccuuagcaucauuacggcugugcugguucucaccuucgugacacccaucaacuccaugguccugggggaaagcaaagagaccuuugagcuugaagaucugccugacgacaugcucgagauggccucucggauuaauuccuauuaccugacauguauccugaacuaugcugugagcuggggacucgucauuaucggccugcuuauuggccuccuguucaagaaguaccaacaccgcuuucugaauguguaugccauguacugcgaagagugugauauguaccacgacaaaucugggcuuaagagacauggagauuucaccaacaaaugccggcaguguacgugcggccaguaugaagacgccgcugggcugauggcgcaccgcaagacauacaauugccucguucaguauaaagccaaguggaugaugaacuuccugaucaucuacauuuuucugauccucauuaaggauagcgcuaucgugguccaagccgccggaaccgacuucaccacaugucuggagaccgaguccauuaacuggaauugcacaggccccuuucuuaaccuggggaauugucagaaacagcaaaagaaagaaccuuauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauugccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaaacuugcuaucucuuccaaaagcauuaagacauguaaaaaugugaaggacguugccugccugucuccucgcuccggcgccaucuaugcuagcauuaucgcguguggagaaccgaacggccccucugucuaccggaagccuagcgggggaguguuccaguccagcaccgauagaucuauuuauugccuccuggacucccauugccuggaggaguuugaagccaucggccaagaggaacuugaugcugugaaaaagagcaaauguugggagauugaguaccccgacgucaagcucauccaggaaggggacggaacaaaauccugccgcaugaaggauucuggcaauuguaacguggccaccaaucgguggccuguuauccagugcgagaacgacaaguucuacuauagcgaacugcagaaagauuacgacaaggcccaagauauugggcacuauugucugucccccggcugcaccacagugagauacccgaucaauccuaaacauauuucuaacuguaauuggcaggucagccgcuccucuaucgcuaagauugacgugcacaacaucgaggauaucgaacaguauaaaaaggccauuacgcagaagcuccaaaccagccugucccuuuuuaaauacgcgaagacaaagaaucugccccacaucaagccuauuuauaaauacaucaccauugagggaacagagaccgcugaaggcaucgagagcgccuacaucgaaucugagguucccgcccucgcugggacguccauuggauucaagaucaacagcaaagaaggcaagcaucugcuggacgugauugccuaugucaagucugcguccuacagcucuguguauacaaaacuuuacuccaccgggccuaccagcggaaucaauacaaagcacgaugagcucugcaccggccccuguccggcuaacauuaaucaucagguuggguggcugacauuugcccgggagagaacguccagcuggggcugcgaagaguucggaugucuggccgugucugacggcugcgucuuugggagcugccaggauaucauuaaagaggaacucuccguguaucgcaaggaaaccgaggaggugacagacgucgaacugugucuuaccuucucugauaaaacauacugcaccaaccugaacccuguuacgcccaucaucaccgaccucuuugaggugcaauucaagacaguggaaaccuauagccugccccggauugucgcugugcagaaucacgagaucaagauuggacagaucaacgaccugggcguuuacuccaaaggguguggaaaugugcagaaggucaacggcacaauuuacgggaauggcgugccuagauuugauuaucuuugccaucuggccucucggaaagagguuaucgugcgcaaguguuucgacaacgauuaccaggcuugcaaauuucuccaaagcccggccuccuauagacuggaagaggacucuggaaccgucacaaucauugauuacaagaagauccucggcaccauuaaaaugaaggcgauccugggggacgugaaauauaagacguucgccgauagcguugacauuacagcugaaggauccuguaccggcugcaucaauuguuucgagaacauccacugcgaacuuacccugcacacaaccauugaggccagcugucccaucaaaucuuccugcacgguguuucaugaucggauucucgucacaccuaaugagcacaaguacgcucugaagauggugugcaccgaaaaacccgggaacacacugaccaucaagguguguaauacaaaagucgaggccagcauggcccuuguugacgcuaagccuauuaucgaacuggcgcccguggaucagaccgccuauauuagagagaaagacgaacgcugcaagacguggaugugucgggugagagacgagggacuccaggucauccuggagccuuucaagaaccucuuuggcucuuacaucggcauuuucuacaccuuuaucauuuccaucgugguucugcuugugauuaucuauguccugcuccccaucugcuucaaacugcgcgauacacugagaaagcaugaagacgcuuacaaacgggagaugaagauucgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17157 - RNA, 4558 nt, Artificial Sequence
  mRNA product Design1 comprising derived and/or modified sequence from LACV(Human/78)__NC_004109.1__IgE-leader_Gn-NSm-Gc (opt5)
gggagaaagcuuaccauggacuggaccuggauccuguuccucguggccgcugcaacaagaguccacagcagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagagucaugugcaaauccaagggcccggccucuauccuuagcaucauuacggcugugcugguucucaccuucgugacacccaucaacuccaugguccugggggaaagcaaagagaccuuugagcuugaagaucugccugacgacaugcucgagauggccucucggauuaauuccuauuaccugacauguauccugaacuaugcugugagcuggggacucgucauuaucggccugcuuauuggccuccuguucaagaaguaccaacaccgcuuucugaauguguaugccauguacugcgaagagugugauauguaccacgacaaaucugggcuuaagagacauggagauuucaccaacaaaugccggcaguguacgugcggccaguaugaagacgccgcugggcugauggcgcaccgcaagacauacaauugccucguucaguauaaagccaaguggaugaugaacuuccugaucaucuacauuuuucugauccucauuaaggauagcgcuaucgugguccaagccgccggaaccgacuucaccacaugucuggagaccgaguccauuaacuggaauugcacaggccccuuucuuaaccuggggaauugucagaaacagcaaaagaaagaaccuuauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauugccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaaacuugcuaucucuuccaaaagcauuaagacauguaaaaaugugaaggacguugccugccugucuccucgcuccggcgccaucuaugcuagcauuaucgcguguggagaaccgaacggccccucugucuaccggaagccuagcgggggaguguuccaguccagcaccgauagaucuauuuauugccuccuggacucccauugccuggaggaguuugaagccaucggccaagaggaacuugaugcugugaaaaagagcaaauguugggagauugaguaccccgacgucaagcucauccaggaaggggacggaacaaaauccugccgcaugaaggauucuggcaauuguaacguggccaccaaucgguggccuguuauccagugcgagaacgacaaguucuacuauagcgaacugcagaaagauuacgacaaggcccaagauauugggcacuauugucugucccccggcugcaccacagugagauacccgaucaauccuaaacauauuucuaacuguaauuggcaggucagccgcuccucuaucgcuaagauugacgugcacaacaucgaggauaucgaacaguauaaaaaggccauuacgcagaagcuccaaaccagccugucccuuuuuaaauacgcgaagacaaagaaucugccccacaucaagccuauuuauaaauacaucaccauugagggaacagagaccgcugaaggcaucgagagcgccuacaucgaaucugagguucccgcccucgcugggacguccauuggauucaagaucaacagcaaagaaggcaagcaucugcuggacgugauugccuaugucaagucugcguccuacagcucuguguauacaaaacuuuacuccaccgggccuaccagcggaaucaauacaaagcacgaugagcucugcaccggccccuguccggcuaacauuaaucaucagguuggguggcugacauuugcccgggagagaacguccagcuggggcugcgaagaguucggaugucuggccgugucugacggcugcgucuuugggagcugccaggauaucauuaaagaggaacucuccguguaucgcaaggaaaccgaggaggugacagacgucgaacugugucuuaccuucucugauaaaacauacugcaccaaccugaacccuguuacgcccaucaucaccgaccucuuugaggugcaauucaagacaguggaaaccuauagccugccccggauugucgcugugcagaaucacgagaucaagauuggacagaucaacgaccugggcguuuacuccaaaggguguggaaaugugcagaaggucaacggcacaauuuacgggaauggcgugccuagauuugauuaucuuugccaucuggccucucggaaagagguuaucgugcgcaaguguuucgacaacgauuaccaggcuugcaaauuucuccaaagcccggccuccuauagacuggaagaggacucuggaaccgucacaaucauugauuacaagaagauccucggcaccauuaaaaugaaggcgauccugggggacgugaaauauaagacguucgccgauagcguugacauuacagcugaaggauccuguaccggcugcaucaauuguuucgagaacauccacugcgaacuuacccugcacacaaccauugaggccagcugucccaucaaaucuuccugcacgguguuucaugaucggauucucgucacaccuaaugagcacaaguacgcucugaagauggugugcaccgaaaaacccgggaacacacugaccaucaagguguguaauacaaaagucgaggccagcauggcccuuguugacgcuaagccuauuaucgaacuggcgcccguggaucagaccgccuauauuagagagaaagacgaacgcugcaagacguggaugugucgggugagagacgagggacuccaggucauccuggagccuuucaagaaccucuuuggcucuuacaucggcauuuucuacaccuuuaucauuuccaucgugguucugcuugugauuaucuauguccugcuccccaucugcuucaaacugcgcgauacacugagaaagcaugaagacgcuuacaaacgggagaugaagauucgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17158 - RNA, 3913 nt, Artificial Sequence
  mRNA product Design1 comprising derived and/or modified sequence from LACV(Human/78)__NC_004109.1__SP-GP_Gn-4aa-Gc (opt5)
gggagaaagcuuaccaugaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagauauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauugccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaaacuugcuaucucuuccaaaagcauuaagacauguaaaaaugugaaggacguugccugccugucuccucgcuccggcgccaucuaugcuagcauuaucgcguguggagaaccgaacggccccucugucuaccggaagccuagcgggggaguguuccaguccagcaccgauagaucuauuuauugccuccuggacucccauugccuggaggaguuugaagccaucggccaagaggaacuugaugcugugaaaaagagcaaauguugggagauugaguaccccgacgucaagcucauccaggaaggggacggaacaaaauccugccgcaugaaggauucuggcaauuguaacguggccaccaaucgguggccuguuauccagugcgagaacgacaaguucuacuauagcgaacugcagaaagauuacgacaaggcccaagauauugggcacuauugucugucccccggcugcaccacagugagauacccgaucaauccuaaacauauuucuaacuguaauuggcaggucagccgcuccucuaucgcuaagauugacgugcacaacaucgaggauaucgaacaguauaaaaaggccauuacgcagaagcuccaaaccagccugucccuuuuuaaauacgcgaagacaaagaaucugccccacaucaagccuauuuauaaauacaucaccauugagggaacagagaccgcugaaggcaucgagagcgccuacaucgaaucugagguucccgcccucgcugggacguccauuggauucaagaucaacagcaaagaaggcaagcaucugcuggacgugauugccuaugucaagucugcguccuacagcucuguguauacaaaacuuuacuccaccgggccuaccagcggaaucaauacaaagcacgaugagcucugcaccggccccuguccggcuaacauuaaucaucagguuggguggcugacauuugcccgggagagaacguccagcuggggcugcgaagaguucggaugucuggccgugucugacggcugcgucuuugggagcugccaggauaucauuaaagaggaacucuccguguaucgcaaggaaaccgaggaggugacagacgucgaacugugucuuaccuucucugauaaaacauacugcaccaaccugaacccuguuacgcccaucaucaccgaccucuuugaggugcaauucaagacaguggaaaccuauagccugccccggauugucgcugugcagaaucacgagaucaagauuggacagaucaacgaccugggcguuuacuccaaaggguguggaaaugugcagaaggucaacggcacaauuuacgggaauggcgugccuagauuugauuaucuuugccaucuggccucucggaaagagguuaucgugcgcaaguguuucgacaacgauuaccaggcuugcaaauuucuccaaagcccggccuccuauagacuggaagaggacucuggaaccgucacaaucauugauuacaagaagauccucggcaccauuaaaaugaaggcgauccugggggacgugaaauauaagacguucgccgauagcguugacauuacagcugaaggauccuguaccggcugcaucaauuguuucgagaacauccacugcgaacuuacccugcacacaaccauugaggccagcugucccaucaaaucuuccugcacgguguuucaugaucggauucucgucacaccuaaugagcacaaguacgcucugaagauggugugcaccgaaaaacccgggaacacacugaccaucaagguguguaauacaaaagucgaggccagcauggcccuuguugacgcuaagccuauuaucgaacuggcgcccguggaucagaccgccuauauuagagagaaagacgaacgcugcaagacguggaugugucgggugagagacgagggacuccaggucauccuggagccuuucaagaaccucuuuggcucuuacaucggcauuuucuacaccuuuaucauuuccaucgugguucugcuugugauuaucuauguccugcuccccaucugcuucaaacugcgcgauacacugagaaagcaugaagacgcuuacaaacgggagaugaagauucgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17159 - RNA, 3928 nt, Artificial Sequence
  mRNA product Design1 comprising derived and/or modified sequence from LACV(Human/78)__NC_004109.1__IgE-leader_Gn-4aa-Gc (opt5)
gggagaaagcuuaccauggacuggaccuggauccuguuccucguggccgcugcaacaagaguccacagcagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagauauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauugccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaaacuugcuaucucuuccaaaagcauuaagacauguaaaaaugugaaggacguugccugccugucuccucgcuccggcgccaucuaugcuagcauuaucgcguguggagaaccgaacggccccucugucuaccggaagccuagcgggggaguguuccaguccagcaccgauagaucuauuuauugccuccuggacucccauugccuggaggaguuugaagccaucggccaagaggaacuugaugcugugaaaaagagcaaauguugggagauugaguaccccgacgucaagcucauccaggaaggggacggaacaaaauccugccgcaugaaggauucuggcaauuguaacguggccaccaaucgguggccuguuauccagugcgagaacgacaaguucuacuauagcgaacugcagaaagauuacgacaaggcccaagauauugggcacuauugucugucccccggcugcaccacagugagauacccgaucaauccuaaacauauuucuaacuguaauuggcaggucagccgcuccucuaucgcuaagauugacgugcacaacaucgaggauaucgaacaguauaaaaaggccauuacgcagaagcuccaaaccagccugucccuuuuuaaauacgcgaagacaaagaaucugccccacaucaagccuauuuauaaauacaucaccauugagggaacagagaccgcugaaggcaucgagagcgccuacaucgaaucugagguucccgcccucgcugggacguccauuggauucaagaucaacagcaaagaaggcaagcaucugcuggacgugauugccuaugucaagucugcguccuacagcucuguguauacaaaacuuuacuccaccgggccuaccagcggaaucaauacaaagcacgaugagcucugcaccggccccuguccggcuaacauuaaucaucagguuggguggcugacauuugcccgggagagaacguccagcuggggcugcgaagaguucggaugucuggccgugucugacggcugcgucuuugggagcugccaggauaucauuaaagaggaacucuccguguaucgcaaggaaaccgaggaggugacagacgucgaacugugucuuaccuucucugauaaaacauacugcaccaaccugaacccuguuacgcccaucaucaccgaccucuuugaggugcaauucaagacaguggaaaccuauagccugccccggauugucgcugugcagaaucacgagaucaagauuggacagaucaacgaccugggcguuuacuccaaaggguguggaaaugugcagaaggucaacggcacaauuuacgggaauggcgugccuagauuugauuaucuuugccaucuggccucucggaaagagguuaucgugcgcaaguguuucgacaacgauuaccaggcuugcaaauuucuccaaagcccggccuccuauagacuggaagaggacucuggaaccgucacaaucauugauuacaagaagauccucggcaccauuaaaaugaaggcgauccugggggacgugaaauauaagacguucgccgauagcguugacauuacagcugaaggauccuguaccggcugcaucaauuguuucgagaacauccacugcgaacuuacccugcacacaaccauugaggccagcugucccaucaaaucuuccugcacgguguuucaugaucggauucucgucacaccuaaugagcacaaguacgcucugaagauggugugcaccgaaaaacccgggaacacacugaccaucaagguguguaauacaaaagucgaggccagcauggcccuuguugacgcuaagccuauuaucgaacuggcgcccguggaucagaccgccuauauuagagagaaagacgaacgcugcaagacguggaugugucgggugagagacgagggacuccaggucauccuggagccuuucaagaaccucuuuggcucuuacaucggcauuuucuacaccuuuaucauuuccaucgugguucugcuugugauuaucuauguccugcuccccaucugcuucaaacugcgcgauacacugagaaagcaugaagacgcuuacaaacgggagaugaagauucgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17160 - RNA, 925 nt, Artificial Sequence
  mRNA product Design1 comprising derived and/or modified sequence from LACV(Human/78)__NC_004109.1__N (opt11)
gggagaaagcuuaccauguccgaccucguauucuacgacguagccucaacaggcgccaacggauucgacccagacgccggauacauggacuucugcgucaaaaacgccgaacuccucaaccucgccgccguccgcaucuucuuccucaacgccgccaaagccaaagcagcccuaucccgcaaacccgaacgaaaagccaaccccaaauucggcgaauggcaagucgaagucaucaacaaccacuuccccggcaaccgcaacaacccaaucggcaacaacgaccucaccauacaccgacuuuccggcuaccucgcccgauggguccucgaccaauacaacgaaaacgacgacgaaucccaacacgaacuaauacgcacaaccaucaucaaccccaucgccgaguccaacggcgucggcugggacuccggacccgaaauauaccucuccuucuuccccggcacagaaauguuccuagaaaccuucaaauucuacccacucacuaucggcauccacagaguaaaacaaggaaugauggacccccaauaccucaaaaaagcccuacgacaacgcuacggaacccuuaccgccgacaaauggaugucacaaaaagucgccgccaucgccaaaucccucaaagacguagaacaacucaaauggggaaaaggcggccucucagacaccgccaaaaccuuccuccaaaaauucggcauccgacucccauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17161 - RNA, 4543 nt, Artificial Sequence; identical to SEQ ID NO: 17151
  mRNA product Design1 comprising derived and/or modified sequence from LACV(Human/78)__NC_004109.1__GP (opt11)

SEQ ID NO: 17162 - RNA, 4558 nt, Artificial Sequence
  mRNA product Design1 comprising derived and/or modified sequence from LACV(Human/78)__NC_004109.1__IgE-leader_Gn-NSm-Gc (opt11)
gggagaaagcuuaccauggacuggaccuggauccuguuccucguggccgcugcaacaagaguccacagcagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagacguacaacugccuggugcaguacaaggcgaaguggaugaugaacuuccucaucaucuacaucuuccugauccugaucaaggacuccgccaucgucgugcaggccgccggcaccgacuucacgaccugccucgagaccgagagcaucaacuggaacugcaccggccccuuccugaaccuggggaacugccagaagcagcagaagaaggagccguacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17163 - RNA, 3913 nt, Artificial Sequence; identical to SEQ ID NO: 17153
  mRNA product Design1 comprising derived and/or modified sequence from LACV(Human/78)__NC_004109.1__SP-GP_Gn-4aa-Gc (opt11)

SEQ ID NO: 17164 - RNA, 3928 nt, Artificial Sequence
  mRNA product Design1 comprising derived and/or modified sequence from LACV(Human/78)__NC_004109.1__IgE-leader_Gn-4aa-Gc (opt11)
gggagaaagcuuaccauggacuggaccuggauccuguuccucguggccgcugcaacaagaguccacagcagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcuacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17165 - RNA, 1090 nt, Artificial Sequence
  mRNA product Design2 comprising derived and/or modified sequence from LACV(Human/78)__NC_004109.1__N (wt)
ggggcgcugccuacggagguggcagccaucuccuucucggcaucaagcuuaccaugucggauuugguguuuuaugaugucgcaucaacaggugcaaauggauuugauccugaugcaggguauauggacuucuguguuaaaaaugcagaauuacucaaccuugcugcaguuaggaucuucuuccucaaugccgcaaaggccaaggcugcucucucgcguaagccagagaggaaggcuaacccuaaauuuggagaguggcagguggagguuaucaauaaucauuuuccuggaaacaggaacaacccaauugguaacaacgaucuuaccauccacagauuaucuggguauuuagccagauggguccuugaucaguauaacgagaaugaugaugagucucagcacgaguugaucagaacaacuauuaucaacccaauugcugagucuaaugguguaggaugggacagugggccagagaucuaucuaucauucuuuccaggaacagaaauguuuuuggaaacuuucaaauucuacccgcugaccauuggaauucacagagucaagcaaggcaugauggacccucaauaccugaagaaggccuuaaggcaacgcuauggcacucucacagcagauaaguggaugucacagaagguugcagcaauugcuaagagccugaaggauguagagcagcuuaaauggggaaaaggaggccugagcgauacugcuaaaacauuccugcagaaauuuggcaucaggcuuccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17166 - RNA, 1090 nt, Artificial Sequence
  mRNA product Design2 comprising derived and/or modified sequence from LACV(Human/78)__NC_004109.1__N (wt)
ggggcgcugccuacggagguggcagccaucuccuucucggcaucaagcuuaccaugucggauuugguguuuuaugaugucgcaucaacaggugcaaauggauuugauccugaugcaggguauauggacuucuguguuaaaaaugcagaauuacucaaccuugcugcaguuaggaucuucuuccucaaugccgcaaaggccaaggcugcucucucgcguaagccagagaggaaggcuaacccuaaauuuggagaguggcaggucgagguuaucaauaaucauuuuccuggaaacaggaacaacccaauugguaacaacgaucuuaccauccacagauuaucuggguauuuagccagauggguccuugaucaguauaacgagaaugaugaugagucucagcacgaguugaucagaacaacuauuaucaacccaauugcugagucuaaugguguaggaugggacagugggccagagaucuaucuaucauucuuuccaggaacagaaauguuuuuggaaacuuucaaauucuacccgcugaccauuggaauccacagagucaagcaaggcaugauggacccucaauaccugaagaaggccuuaaggcaacgcuauggcacucucacagcagauaaguggaugucacagaagguugcagcaauugcuaagagccugaaggauguagagcagcuuaaauggggaaaaggaggccugagcgauacugcuaaaacauuccugcagaaauuuggcaucaggcuuccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17167 - RNA, 4708 nt, Artificial Sequence
  mRNA product Design2 comprising derived and/or modified sequence from LACV(Human/78)__NC_004109.1__GP (wt)
ggggcgcugccuacggagguggcagccaucuccuucucggcaucaagcuuaccaugauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17168 - RNA, 4708 nt, Artificial Sequence
  mRNA product Design2 comprising derived and/or modified sequence from LACV(Human/78)__NC_004109.1__GP (wt)
ggggcgcugccuacggagguggcagccaucuccuucucggcaucaagcuuaccaugauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaguucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17169 - RNA, 4723 nt, Artificial Sequence
  mRNA product Design2 comprising derived and/or modified sequence from LACV(Human/78)__NC_004109.1__IgE-leader_Gn-NSm-Gc (wt)
ggggcgcugccuacggagguggcagccaucuccuucucggcaucaagcuuaccauggacuggaccuggauccuguuccucguggccgccgcgacccgcguccacagcagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17170 - RNA, 4723 nt, Artificial Sequence
  mRNA product Design2 comprising derived and/or modified sequence from LACV(Human/78)__NC_004109.1__IgE-leader_Gn-NSm-Gc (wt)
ggggcgcugccuacggagguggcagccaucuccuucucggcaucaagcuuaccauggacuggaccuggauccuguuccucguggccgccgcgacccgcguccacagcagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagagucaugugcaagucgaaagggccugcaucaauauugucuauaauuacugcgguacuggucuuaaccuuugugacaccaaucaacuccaugguuuuaggagagaguaaagaaaccuuugaacuugaagaucuuccagacgacauguuggaaauggcaucgagaauaaauucuuauuaucucaccuguaucuugaauuaugcuguaagcuggggucuuguuaucauuggauuguugaucgggcugcuuuuuaagaaauaccagcacagauucuuaaauguuuacgcaauguacugugaagaaugugacauguaucaugacaagucuggguugaaaagacauggugauuucaccaacaaaugcagacagugcacauguggucaauaugaagaugcugcagguuugauggcucacaggaaaaccuauaacugcuuagugcaguacaaagcaaaguggaugaugaacuuccugauaauuuacauauucuuaauuuugaucaaagauucugcuauaguuguacaagcugcuggaacugacuucaccaccugccuagagacugagaguauaaauuggaacugcacugggccauuuuugaaccucgggaauugccaaaagcaacaaaagaaagaaccuuacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaguucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17171 - RNA, 4078 nt, Artificial Sequence
  mRNA product Design2 comprising derived and/or modified sequence from LACV(Human/78)__NC_004109.1__SP-GP_Gn-4aa-Gc (wt)
ggggcgcugccuacggagguggcagccaucuccuucucggcaucaagcuuaccaugauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagauacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17172 - RNA, 4078 nt, Artificial Sequence
  mRNA product Design2 comprising derived and/or modified sequence from LACV(Human/78)__NC_004109.1__SP-GP_Gn-4aa-Gc (wt)
ggggcgcugccuacggagguggcagccaucuccuucucggcaucaagcuuaccaugauuuguauauuggugcuaauuacaguugcagcugcaagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagauacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaguucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17173 - RNA, 4093 nt, Artificial Sequence
  mRNA product Design2 comprising derived and/or modified sequence from LACV(Human/78)__NC_004109.1__IgE-leader_Gn-4aa-Gc (wt)
ggggcgcugccuacggagguggcagccaucuccuucucggcaucaagcuuaccauggacuggaccuggauccuguuccucguggccgccgcgacccgcguccacagcagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagauacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaauucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17174 - RNA, 4093 nt, Artificial Sequence
  mRNA product Design2 comprising derived and/or modified sequence from LACV(Human/78)__NC_004109.1__IgE-leader_Gn-4aa-Gc (wt)
ggggcgcugccuacggagguggcagccaucuccuucucggcaucaagcuuaccauggacuggaccuggauccuguuccucguggccgccgcgacccgcguccacagcagcccaguguaucaaagguguuuccaagauggggcuauagugaagcaaaacccauccaaagaagcaguuacagaggugugccugaaagaugauguuagcaugaucaaaacagaggccagguauguaagaaaugcaacaggaguuuuuucaaauaaugucgcaauaaggaaauggcuagucucugauuggcaugauugcaggccuaagaagaucguugggggacacaucaauguaauagaaguuggugaugaccugucacuccauacugaaucauauguuugcagcgcagauuguaccauagguguagacaaagagacugcacaggucaggcuucagacagauaccacaaaucauuuugaaauugcaggcacuacugugaagucaggaugguucaagagcacgacauauauaacucuugaucaaacuugcgaacaccuuaaaguuuccugcggcccaaaaucuguacaguuccaugccugcuucaaucagcauaugucuugcgucagauuuuuacacaggacaauauugccuggcucuauagccaauuccauaugucagaauaucgaaaucauaauuuuaguuacacuuacucuauuaaucuuuauauuguuaagcauuuuaaguaagacuuauauauguuauuuauuaaugccuauauucauccccauagcauauauauacgguauaauuuacaauaagucgugcaaaaaaugcaaauuauguggcuuaguguaucauccauucacagaguguggcacacauugugucuguggugcccgcuaugauacuucagauagaaugaaacugcauagagcuucuggauugugcccugguuauaaaagccuaagagcugccagauacaccaacauugcaacucaguuaaagggacuaaaggcaauuuccguacuagaugucccuauaauaacagggauaccagaugauauugcgggugcuuuaagauauauagaagagaaggaagauuuccauguccagcuaacuauagaauaugcgauguuaagcaaauacugugacuauuauacccaauucucagauaacucaggauacagucagacaacauggagaguguacuuaaggucucaugauuuugaagccuguauacuauauccaaaucagcacuuuugcagauguguaaaaaauggugagaagugcagcagcuccaauugggacuuugccaaugaaaugaaagauuauuacucugggaaacaaacaaaguuugacaaggacuuaaaucuagcccuaacagcuuugcaucaugccuucagggggaccucaucugcauauauagcaacaaugcucucaaaaaaguccaaugaugacuugauugcauacacaaauaagauaaaaacaaaauucccagguaaugcauuguugaaggcuauaauagauuauauagcauauaugaaaaguuugccagguauggcaaauuucaaauaugaugaguucugggaugaauuacuguacaaacccaacccagcaaaggccucaaaccuugcuagaggaaaggagucaucuuacaacuucaaacuagcaauuucaucaaagucuauaaaaaccugcaagaauguuaaggauguugccugcuuaucgccaaggucaggugcuauauaugcuucaauaauugcguguggugaacccaaugggccaaguguguauaggaaaccaucaggugguguauuccaaucuagcacugaucggucuauauacugcuugcuggauagccauugucuagaagaauuugaggccaucggccaggaggagcuggaugcgguaaagaaauccaaauguugggaaauugaauauccugacguaaagcucauccaagaaggcgaugggacuaaaagcuguagaaugaaagauucugggaacugcaauguugcaacuaacagauggccagugauacaaugugagaaugacaaauuuuacuacucagagcuucaaaaagauuaugacaaagcucaagauauuggucacuauugcuuaagcccuggauguacuacuguccgguacccuauuaauccaaagcacaucucuaacuguaauuggcaaguaagcagaucuagcauagcgaagauagaugugcacaauauugaggauauugagcaauauaagaaagcuauaacucagaaacuucaaacgagccuaucucuauucaaguaugcaaaaacaaaaaacuugccgcacaucaaaccaauuuauaaauauauaacuauagaaggaacagaaacugcagaagguauagagagugcauacauugaaucagaaguaccugcauuggcugggacaucuaucggauucaaaaucaauucuaaagagggcaagcacuugcuagauguuauagcauauguaaaaagugccucauacucuucaguguauacaaaauuguacucaacuggcccaacaucagggauaaauacuaaacaugaugaauuguguacuggcccaugcccagcaaauaucaaucaucagguuggguggcugacauuugcaagagagaggacaagcucauggggaugcgaagaguuugguugccuggcuguaagugauggguguguauuuggaucaugccaagauauaauaaaagaagaacuaucugucuauaggaaggagaccgaggaagugacugauguagaacuguguuugacauuuucagacaaaacauacuguacaaacuuaaacccuguuaccccuauuauaacagaucuauuugagguacaguucaaaacuguagagaccuacagcuugccuagaauuguugcugugcaaaaccaugagauuaaaauugggcaaauaaaugauuuaggaguuuacucuaaggguugugggaauguucaaaaggucaauggaacuauuuauggcaauggaguucccagauuugacuacuuaugccauuuagcuagcaggaaggaagucauuguuagaaaaugcuucgacaaugauuaccaagcaugcaaauuucuucaaagcccugcuaguuacagacuugaagaagacaguggcacugugaccauaauugacuacaaaaagauuuuaggaacaaucaagaugaaggcaauuuuaggagaugucaaauauaaaacauuugcugauagugucgauauaaccgcagaagggucaugcaccggcuguauuaacugcuucgaaaauauccauugcgaauuaacguugcacaccacaauugaagccagcugcccaauuaaaagcucgugcacaguauuucaugacaggauucuugugacuccaaaugaacacaaauaugcauugaaaauggugugcacagaaaagccagggaacacacucacaauuaaagucugcaauacuaaaguugaagcaucuauggcccuuguagacgcaaagccuaucauagaacuagcaccaguugaucagacagcauauauaagagaaaaagaugaaagguguaaaacuuggauguguaggguaagagaugaaggacugcaggucaucuuggagccauuuaaaaauuuauuuggaucuuauauugggauauuuuacacauuuauuauaucuauaguaguauuauugguuauuaucuauguacuacuaccuauaugcuuuaaguuaagggauacccuuagaaagcaugaagaugcauauaagagagagaugaaaauuagauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17175 - RNA, 1090 nt, Artificial Sequence
  mRNA product Design2 comprising derived and/or modified sequence from LACV(Human/78)__NC_004109.1__N (opt4)
ggggcgcugccuacggagguggcagccaucuccuucucggcaucaagcuuaccaugagcgaccugguguucuacgacguggccagcaccggcgccaacggcuucgaccccgacgccggcuacauggacuucugcgugaagaacgccgagcugcugaaccuggccgccgugagaaucuucuuccugaacgccgccaaggccaaggccgcccugagcagaaagcccgagagaaaggccaaccccaaguucggcgaguggcagguggaggugaucaacaaccacuuccccggcaacagaaacaaccccaucggcaacaacgaccugaccauccacagacugagcggcuaccuggccagaugggugcuggaccaguacaacgagaacgacgacgagagccagcacgagcugaucagaaccaccaucaucaaccccaucgccgagagcaacggcgugggcugggacagcggccccgagaucuaccugagcuucuuccccggcaccgagauguuccuggagaccuucaaguucuacccccugaccaucggcauccacagagugaagcagggcaugauggacccccaguaccugaagaaggcccugagacagagauacggcacccugaccgccgacaaguggaugagccagaagguggccgccaucgccaagagccugaaggacguggagcagcugaaguggggcaagggcggccugagcgacaccgccaagaccuuccugcagaaguucggcaucagacugcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17176 - RNA, 4708 nt, Artificial Sequence
  mRNA product Design2 comprising derived and/or modified sequence from LACV(Human/78)__NC_004109.1__GP (opt4)
ggggcgcugccuacggagguggcagccaucuccuucucggcaucaagcuuaccaugaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaaggcccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagguggaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggugcugcuggugaucaucuacgugcugcugcccaucugcuucaagcugagagacacccugagaaagcacgaggacgccuacaagagagagaugaagaucagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17177 - RNA, 4723 nt, Artificial Sequence
  mRNA product Design2 comprising derived and/or modified sequence from LACV(Human/78)__NC_004109.1__IgE-leader_Gn-NSm-Gc (opt4)
ggggcgcugccuacggagguggcagccaucuccuucucggcaucaagcuuaccauggacuggaccuggauccuguuccucguggccgcugcaacaagaguccacagcagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaaggcccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagguggaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggugcugcuggugaucaucuacgugcugcugcccaucugcuucaagcugagagacacccugagaaagcacgaggacgccuacaagagagagaugaagaucagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17178 - RNA, 4078 nt, Artificial Sequence
  mRNA product Design2 comprising derived and/or modified sequence from LACV(Human/78)__NC_004109.1__SP-GP_Gn-4aa-Gc (opt4)
ggggcgcugccuacggagguggcagccaucuccuucucggcaucaagcuuaccaugaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagauacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaaggcccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagguggaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggugcugcuggugaucaucuacgugcugcugcccaucugcuucaagcugagagacacccugagaaagcacgaggacgccuacaagagagagaugaagaucagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17179 - RNA, 4093 nt, Artificial Sequence
  mRNA product Design2 comprising derived and/or modified sequence from LACV(Human/78)__NC_004109.1__IgE-leader_Gn-4aa-Gc (opt4)
ggggcgcugccuacggagguggcagccaucuccuucucggcaucaagcuuaccauggacuggaccuggauccuguuccucguggccgcugcaacaagaguccacagcagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagauacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaaggcccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagguggaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggugcugcuggugaucaucuacgugcugcugcccaucugcuucaagcugagagacacccugagaaagcacgaggacgccuacaagagagagaugaagaucagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17180 - RNA, 1090 nt, Artificial Sequence
  mRNA product Design2 comprising derived and/or modified sequence from LACV(Human/78)__NC_004109.1__N (opt3)
ggggcgcugccuacggagguggcagccaucuccuucucggcaucaagcuuaccaugagcgaccugguguucuacgaugucgccuccaccggcgcuaacggguuugaccccgaugcaggauauauggacuucugcguuaagaaugccgagcuccuuaaccuggcggcugugagaaucuuuuucuugaaugccgcaaaagccaaggcugcauuaucuaggaaaccugaacggaaggccaacccaaaauuuggugaguggcagguagaagugauuaauaaccacuucccgggcaaucgcaacaaucccauagggaacaaugaucugacaauccaucgacuaucaggauaccucgcucguuggguccuggaccaauauaacgagaaugaugacgaaagucagcacgagcuuauuagaacuacgaucauuaacccuaucgccgagagcaauggcguggguugggauuccgggccagaaauauaccugucguuuuuccccggaaccgagauguuuuuggaaacauucaaguuuuauccucucacuaucggcauucauaggguuaagcagggcaugauggacccacaguaccugaaaaaggcgcugcggcaacgcuaugggacccucacagcagauaaauggaugucucagaagguggccgcuaucgccaaaucauuaaaggacgucgagcagcugaaguggggaaaagguggccuuagcgauaccgcaaagacuuucuugcagaaauuugggauuagacugcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17181 - RNA, 4708 nt, Artificial Sequence
  mRNA product Design2 comprising derived and/or modified sequence from LACV(Human/78)__NC_004109.1__GP (opt3)
ggggcgcugccuacggagguggcagccaucuccuucucggcaucaagcuuaccaugaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgggugaugugcaaaucaaagggcccagccagcauucuuaguaucauuacagcaguucugguguugaccuucgucacucccauaaacucuauggugcucggggaauccaaagagacauuugagcuggaagauuuaccugacgacaugcuggagauggcuagccgcaucaauucguauuaccucaccuguauucuuaacuaugccguaucuuggggacugguuaucaucggcuugcuaauuggucugcucuuuaagaaguaccaacaccgauuucugaauguguaugcgauguacugcgaagagugugauauguaccacgacaaauccgggcuuaagagacauggagauuucacgaacaaaugcaggcaguguaccugcggccaguaugaagacgccgcaggccugauggcucaccggaagacauacaauugcuugguccaguauaaagccaaguggaugaugaacuuccucauaaucuacauuuuucugaucuuaauuaaggauucagcuaucgugguccaagccgcagggacugacuucaccacaugucuggagacugagaguauaaacuggaauugcaccggaccauuucuaaaccucgguaauugucagaaacagcaaaagaaagaaccguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacgacuucgaggcuuguauucuguacccaaaccagcauuuuuguaggugcgucaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauaucgcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaaaaugugaaggacguugccugcuuauccccgcgcucaggagcgauuuaugccagcaucaucgcuuguggugaaccuaacggccccucuguguacagaaagccauccgggggagucuuccagaguagcacugauaggucuauuuauugccugcuugacucccauugcuuggaggaguuugaagcaaucggccaagaggaacucgaugccgugaaaaagucaaaauguugggagauugaguacccugacguaaagcugauacaggaaggugacgggacaaaaaguugccggaugaaggauagcggcaauuguaacguggcuaccaaucgcuggcccguuauccagugcgagaacgacaaguucuacuauucggaacuacagaaagauuacgacaaggcccaagauauuggacacuauugucuguccccaggcugcacaacugucagauaccccaucaauccuaaacauauuucuaacuguaauuggcaagugagcaggucaaguaucgcaaagauagacgugcacaacaucgaggauauugaacaguauaaaaaggcgaucacccagaagcuccaaacgucccugucucuuuuuaaauacgccaagaccaaaaauuugccacacauuaagccgaucuauaaauacauaacaauugaggggacugagaccgcugaaggaaucgagagcgccuacaucgaauccgagguccccgcacuggcugguacaucaauuggcuucaagauaaacagcaaagaagggaagcauuuacucgacguuaucgccuaugugaagagugcaucuuacuccagcguguauacuaaacuguacucgaccggaccuacgucaggcauuaauacaaagcacgaugagcuuugcaccgguccaugucccgccaacaucaaucaucagguaggguggcugacuuuugcucgugagcggacaucuaguuggggcugcgaagaguucggauguuuggcggucuccgacggcugcguguuugggagcugccaggauauuaucaaagaggaacucucuguuuaucgaaaggaaaccgaggaggugacugacgucgaacugugucuaaccuucagcgauaaaacauacugcacgaaccugaacccugugaccccaauaaucacugaccucuuugagguucaauucaagacaguggaaaccuauucccugcccagaauuguagccguccagaaucacgagaucaagauuggacagaucaacgaccuuggcguguacucaaaagguugugggaaugugcagaaggucaacggaacaauauacggcaaugguguuccgagguuugauuauuugugccaucuggcaagucgcaaagaggugauuguacggaaguguuucgacaacgauuaccaggcuugcaaauuuuuacagagcccugccucuuauagacucgaagaggacuccggcacugugaccaucaucgauuacaagaagauucuggggacgaucaaaaugaaggccauacuuggagacgucaaauauaagacauucgcugauucaguggacauuaccgcagaaggcaguuguacugggugcaucaauuguuucgagaacauucacugcgaacugacccuacacacaacuaucgaggccagcuguccaauaaaauccucuugcaccguuuuucaugauaggauucucgugacacccaaugagcacaaguacgcgcugaagauggucugcacggaaaaaccuggaaacaccuugacuaucaagguguguaauacaaaaguugaggcuucgauggcccugguggacgcaaagcccaucauugaauuagccccagucgaucagaccgcuuauauccgcgagaaagacgaacgaugcaagacuuggaugugucggguacgugacgagggccuccaggugauucuggagccuuucaagaaccuuuuugguagcuacauagggaucuucuacacauuuauuaucucaaucguugugcuguuggucauuauauaugugcuccugcccaucugcuucaaacuaagagauacccugaggaagcaugaagacgcauacaaacgcgagaugaagauucggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17182 - RNA, 4723 nt, Artificial Sequence
  mRNA product Design2 comprising derived and/or modified sequence from LACV(Human/78)__NC_004109.1__IgE-leader_Gn-NSm-Gc (opt3)
ggggcgcugccuacggagguggcagccaucuccuucucggcaucaagcuuaccauggacuggaccuggauccuguuccucguggccgcugcaacaagaguccacagcagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgggugaugugcaaaucaaagggcccagccagcauucuuaguaucauuacagcaguucugguguugaccuucgucacucccauaaacucuauggugcucggggaauccaaagagacauuugagcuggaagauuuaccugacgacaugcuggagauggcuagccgcaucaauucguauuaccucaccuguauucuuaacuaugccguaucuuggggacugguuaucaucggcuugcuaauuggucugcucuuuaagaaguaccaacaccgauuucugaauguguaugcgauguacugcgaagagugugauauguaccacgacaaauccgggcuuaagagacauggagauuucacgaacaaaugcaggcaguguaccugcggccaguaugaagacgccgcaggccugauggcucaccggaagacauacaauugcuugguccaguauaaagccaaguggaugaugaacuuccucauaaucuacauuuuucugaucuuaauuaaggauucagcuaucgugguccaagccgcagggacugacuucaccacaugucuggagacugagaguauaaacuggaauugcaccggaccauuucuaaaccucgguaauugucagaaacagcaaaagaaagaaccguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacgacuucgaggcuuguauucuguacccaaaccagcauuuuuguaggugcgucaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauaucgcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaaaaugugaaggacguugccugcuuauccccgcgcucaggagcgauuuaugccagcaucaucgcuuguggugaaccuaacggccccucuguguacagaaagccauccgggggagucuuccagaguagcacugauaggucuauuuauugccugcuugacucccauugcuuggaggaguuugaagcaaucggccaagaggaacucgaugccgugaaaaagucaaaauguugggagauugaguacccugacguaaagcugauacaggaaggugacgggacaaaaaguugccggaugaaggauagcggcaauuguaacguggcuaccaaucgcuggcccguuauccagugcgagaacgacaaguucuacuauucggaacuacagaaagauuacgacaaggcccaagauauuggacacuauugucuguccccaggcugcacaacugucagauaccccaucaauccuaaacauauuucuaacuguaauuggcaagugagcaggucaaguaucgcaaagauagacgugcacaacaucgaggauauugaacaguauaaaaaggcgaucacccagaagcuccaaacgucccugucucuuuuuaaauacgccaagaccaaaaauuugccacacauuaagccgaucuauaaauacauaacaauugaggggacugagaccgcugaaggaaucgagagcgccuacaucgaauccgagguccccgcacuggcugguacaucaauuggcuucaagauaaacagcaaagaagggaagcauuuacucgacguuaucgccuaugugaagagugcaucuuacuccagcguguauacuaaacuguacucgaccggaccuacgucaggcauuaauacaaagcacgaugagcuuugcaccgguccaugucccgccaacaucaaucaucagguaggguggcugacuuuugcucgugagcggacaucuaguuggggcugcgaagaguucggauguuuggcggucuccgacggcugcguguuugggagcugccaggauauuaucaaagaggaacucucuguuuaucgaaaggaaaccgaggaggugacugacgucgaacugugucuaaccuucagcgauaaaacauacugcacgaaccugaacccugugaccccaauaaucacugaccucuuugagguucaauucaagacaguggaaaccuauucccugcccagaauuguagccguccagaaucacgagaucaagauuggacagaucaacgaccuuggcguguacucaaaagguugugggaaugugcagaaggucaacggaacaauauacggcaaugguguuccgagguuugauuauuugugccaucuggcaagucgcaaagaggugauuguacggaaguguuucgacaacgauuaccaggcuugcaaauuuuuacagagcccugccucuuauagacucgaagaggacuccggcacugugaccaucaucgauuacaagaagauucuggggacgaucaaaaugaaggccauacuuggagacgucaaauauaagacauucgcugauucaguggacauuaccgcagaaggcaguuguacugggugcaucaauuguuucgagaacauucacugcgaacugacccuacacacaacuaucgaggccagcuguccaauaaaauccucuugcaccguuuuucaugauaggauucucgugacacccaaugagcacaaguacgcgcugaagauggucugcacggaaaaaccuggaaacaccuugacuaucaagguguguaauacaaaaguugaggcuucgauggcccugguggacgcaaagcccaucauugaauuagccccagucgaucagaccgcuuauauccgcgagaaagacgaacgaugcaagacuuggaugugucggguacgugacgagggccuccaggugauucuggagccuuucaagaaccuuuuugguagcuacauagggaucuucuacacauuuauuaucucaaucguugugcuguuggucauuauauaugugcuccugcccaucugcuucaaacuaagagauacccugaggaagcaugaagacgcauacaaacgcgagaugaagauucggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17183 - RNA, 4078 nt, Artificial Sequence
  mRNA product Design2 comprising derived and/or modified sequence from LACV(Human/78)__NC_004109.1__SP-GP_Gn-4aa-Gc (opt3)
ggggcgcugccuacggagguggcagccaucuccuucucggcaucaagcuuaccaugaucugcauucuggugcucauaaccgucgccgcugcaagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacgacuucgaggcuuguauucuguacccaaaccagcauuuuuguaggugcgucaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauaucgcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaaaaugugaaggacguugccugcuuauccccgcgcucaggagcgauuuaugccagcaucaucgcuuguggugaaccuaacggccccucuguguacagaaagccauccgggggagucuuccagaguagcacugauaggucuauuuauugccugcuugacucccauugcuuggaggaguuugaagcaaucggccaagaggaacucgaugccgugaaaaagucaaaauguugggagauugaguacccugacguaaagcugauacaggaaggugacgggacaaaaaguugccggaugaaggauagcggcaauuguaacguggcuaccaaucgcuggcccguuauccagugcgagaacgacaaguucuacuauucggaacuacagaaagauuacgacaaggcccaagauauuggacacuauugucuguccccaggcugcacaacugucagauaccccaucaauccuaaacauauuucuaacuguaauuggcaagugagcaggucaaguaucgcaaagauagacgugcacaacaucgaggauauugaacaguauaaaaaggcgaucacccagaagcuccaaacgucccugucucuuuuuaaauacgccaagaccaaaaauuugccacacauuaagccgaucuauaaauacauaacaauugaggggacugagaccgcugaaggaaucgagagcgccuacaucgaauccgagguccccgcacuggcugguacaucaauuggcuucaagauaaacagcaaagaagggaagcauuuacucgacguuaucgccuaugugaagagugcaucuuacuccagcguguauacuaaacuguacucgaccggaccuacgucaggcauuaauacaaagcacgaugagcuuugcaccgguccaugucccgccaacaucaaucaucagguaggguggcugacuuuugcucgugagcggacaucuaguuggggcugcgaagaguucggauguuuggcggucuccgacggcugcguguuugggagcugccaggauauuaucaaagaggaacucucuguuuaucgaaaggaaaccgaggaggugacugacgucgaacugugucuaaccuucagcgauaaaacauacugcacgaaccugaacccugugaccccaauaaucacugaccucuuugagguucaauucaagacaguggaaaccuauucccugcccagaauuguagccguccagaaucacgagaucaagauuggacagaucaacgaccuuggcguguacucaaaagguugugggaaugugcagaaggucaacggaacaauauacggcaaugguguuccgagguuugauuauuugugccaucuggcaagucgcaaagaggugauuguacggaaguguuucgacaacgauuaccaggcuugcaaauuuuuacagagcccugccucuuauagacucgaagaggacuccggcacugugaccaucaucgauuacaagaagauucuggggacgaucaaaaugaaggccauacuuggagacgucaaauauaagacauucgcugauucaguggacauuaccgcagaaggcaguuguacugggugcaucaauuguuucgagaacauucacugcgaacugacccuacacacaacuaucgaggccagcuguccaauaaaauccucuugcaccguuuuucaugauaggauucucgugacacccaaugagcacaaguacgcgcugaagauggucugcacggaaaaaccuggaaacaccuugacuaucaagguguguaauacaaaaguugaggcuucgauggcccugguggacgcaaagcccaucauugaauuagccccagucgaucagaccgcuuauauccgcgagaaagacgaacgaugcaagacuuggaugugucggguacgugacgagggccuccaggugauucuggagccuuucaagaaccuuuuugguagcuacauagggaucuucuacacauuuauuaucucaaucguugugcuguuggucauuauauaugugcuccugcccaucugcuucaaacuaagagauacccugaggaagcaugaagacgcauacaaacgcgagaugaagauucggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17184 - RNA, 4093 nt, Artificial Sequence
  mRNA product Design2 comprising derived and/or modified sequence from LACV(Human/78)__NC_004109.1__IgE-leader_Gn-4aa-Gc (opt3)
ggggcgcugccuacggagguggcagccaucuccuucucggcaucaagcuuaccauggacuggaccuggauccuguuccucguggccgcugcaacaagaguccacagcagccccguuuaccagagauguuuccaagacggcgccaucgugaagcagaacccuuccaaagaggcgguaacagaagugugccuuaaggaugacgucucuaugauuaaaacugaggcuagguaugugcggaaugccacggggguuuucucaaacaauguggcaauccgcaaguggcuggucagugauuggcacgacugucgaccgaaaaagauugugggaggucauaucaacguaauagaaguuggcgaugacuugagcuuacacaccgaguccuacgugugcucugccgauuguacaaucggggucgacaaggaaacugcucaggugcgucugcagaccgauacaaccaaucauuucgagauugcaggaacuacagugaaaucgggcugguuuaagucaaccacguauaucacucuagaccaaaccugcgagcaccucaaagucagcugugguccaaagaguguucaguuccaugccugcuuuaaccagcacauguccugugugagauuccugcacaggacaauucuucccgggucuaucgcuaauagcauaugccagaacauugaaaucauuauccugguaacuuugacccuccugaucuuuauucugcucuccauauuaucaaaaacauacaucuguuaucugcuuaugccuauuuucaucccaauagccuacauuuauggaaucaucuacaauaagaguugcaagaaaugcaaguuguguggccugguguaccaucccuuuaccgagugcggcacgcacugugucugcggggcgcgguaugauacuagcgaccgcaugaaacuacauagagcaucuggacucuguccugguuacaagucccugagggccgcucgguauacaaacaucgccacccagcugaagggccuuaaagcuauuagcguguuggauguucccaucauuacugggaucccugacgauauagcgggagcacugcguuacauugaggaaaaggaggacuuccaugugcagcucacgaucgaauaugccaugcuguccaaguacugcgauuacuauacacaguuuucugacaauagcggcuacucacaaaccacuuggcgcguauaucuuagaagucacgacuucgaggcuuguauucuguacccaaaccagcauuuuuguaggugcgucaaaaauggugagaagugcuccagcucuaacugggauuucgccaaugaaaugaaagacuauuacucagggaagcagaccaaauuugauaaggacuugaaccucgcacugacagccuuacaccacgcuuuccggggcaccaguagcgccuauaucgcaacuaugcuguccaagaaaucuaaugaugaccuaauagcguacacaaacaagaucaaaacgaaguuucccggaaaugcucuccugaaagccauuaucgauuacauugcauauaugaagucgcuuccuggcauggccaacuucaaauacgacgaguuuugggaugaauugcuguauaagccaaaucccgcuaaggccagcaaccucgcacgagggaaagaguccucauacaacuucaagcuggcuaucaguucuaaaagcauaaagaccuguaaaaaugugaaggacguugccugcuuauccccgcgcucaggagcgauuuaugccagcaucaucgcuuguggugaaccuaacggccccucuguguacagaaagccauccgggggagucuuccagaguagcacugauaggucuauuuauugccugcuugacucccauugcuuggaggaguuugaagcaaucggccaagaggaacucgaugccgugaaaaagucaaaauguugggagauugaguacccugacguaaagcugauacaggaaggugacgggacaaaaaguugccggaugaaggauagcggcaauuguaacguggcuaccaaucgcuggcccguuauccagugcgagaacgacaaguucuacuauucggaacuacagaaagauuacgacaaggcccaagauauuggacacuauugucuguccccaggcugcacaacugucagauaccccaucaauccuaaacauauuucuaacuguaauuggcaagugagcaggucaaguaucgcaaagauagacgugcacaacaucgaggauauugaacaguauaaaaaggcgaucacccagaagcuccaaacgucccugucucuuuuuaaauacgccaagaccaaaaauuugccacacauuaagccgaucuauaaauacauaacaauugaggggacugagaccgcugaaggaaucgagagcgccuacaucgaauccgagguccccgcacuggcugguacaucaauuggcuucaagauaaacagcaaagaagggaagcauuuacucgacguuaucgccuaugugaagagugcaucuuacuccagcguguauacuaaacuguacucgaccggaccuacgucaggcauuaauacaaagcacgaugagcuuugcaccgguccaugucccgccaacaucaaucaucagguaggguggcugacuuuugcucgugagcggacaucuaguuggggcugcgaagaguucggauguuuggcggucuccgacggcugcguguuugggagcugccaggauauuaucaaagaggaacucucuguuuaucgaaaggaaaccgaggaggugacugacgucgaacugugucuaaccuucagcgauaaaacauacugcacgaaccugaacccugugaccccaauaaucacugaccucuuugagguucaauucaagacaguggaaaccuauucccugcccagaauuguagccguccagaaucacgagaucaagauuggacagaucaacgaccuuggcguguacucaaaagguugugggaaugugcagaaggucaacggaacaauauacggcaaugguguuccgagguuugauuauuugugccaucuggcaagucgcaaagaggugauuguacggaaguguuucgacaacgauuaccaggcuugcaaauuuuuacagagcccugccucuuauagacucgaagaggacuccggcacugugaccaucaucgauuacaagaagauucuggggacgaucaaaaugaaggccauacuuggagacgucaaauauaagacauucgcugauucaguggacauuaccgcagaaggcaguuguacugggugcaucaauuguuucgagaacauucacugcgaacugacccuacacacaacuaucgaggccagcuguccaauaaaauccucuugcaccguuuuucaugauaggauucucgugacacccaaugagcacaaguacgcgcugaagauggucugcacggaaaaaccuggaaacaccuugacuaucaagguguguaauacaaaaguugaggcuucgauggcccugguggacgcaaagcccaucauugaauuagccccagucgaucagaccgcuuauauccgcgagaaagacgaacgaugcaagacuuggaugugucggguacgugacgagggccuccaggugauucuggagccuuucaagaaccuuuuugguagcuacauagggaucuucuacacauuuauuaucucaaucguugugcuguuggucauuauauaugugcuccugcccaucugcuucaaacuaagagauacccugaggaagcaugaagacgcauacaaacgcgagaugaagauucggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17185 - RNA, 1090 nt, Artificial Sequence
  mRNA product Design2 comprising derived and/or modified sequence from LACV(Human/78)__NC_004110.1__N (opt1)
ggggcgcugccuacggagguggcagccaucuccuucucggcaucaagcuuaccaugagcgaccugguguucuacgacgucgccuccaccggcgccaacggguucgaccccgacgcgggcuacauggacuucugcgugaagaacgccgagcuccugaaccuggccgccgugcgcaucuucuuccucaacgccgcgaaggccaaggccgcccugagccggaagccggagcgcaaggcgaaccccaaguucggggaguggcaggucgaggugaucaacaaccacuuccccggcaaccggaacaaccccaucgggaacaacgaccugaccauccaccgccucuccggcuaccuggcccggugggugcuggaccaguacaacgagaacgacgacgagagccagcacgagcucauccgcacgaccaucaucaacccgaucgccgaguccaacggcgucgggugggacagcggccccgagaucuaccuguccuucuuccccgggaccgagauguuccuggagaccuucaaguucuacccccucacgaucggcauccaccgggugaagcaggggaugauggacccgcaguaccugaagaaggcccugcgccagcgguacggcacccucaccgccgacaaguggaugagccagaagguggcggccaucgccaagucccugaaggacgucgagcagcugaaguggggcaagggcgggcucagcgacaccgccaagacguuccugcagaaguucgggauccgccugcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17186 - RNA, 4708 nt, Artificial Sequence
  mRNA product Design2 comprising derived and/or modified sequence from LACV(Human/78)__NC_004109.1__GP (opt1)
ggggcgcugccuacggagguggcagccaucuccuucucggcaucaagcuuaccaugaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagacguacaacugccuggugcaguacaaggcgaaguggaugaugaacuuccucaucaucuacaucuuccugauccugaucaaggacuccgccaucgucgugcaggccgccggcaccgacuucacgaccugccucgagaccgagagcaucaacuggaacugcaccggccccuuccugaaccuggggaacugccagaagcagcagaagaaggagccguacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17187 - RNA, 4723 nt, Artificial Sequence
  mRNA product Design2 comprising derived and/or modified sequence from LACV(Human/78)__NC_004109.1__IgE-leader_Gn-NSm-Gc (opt1)
ggggcgcugccuacggagguggcagccaucuccuucucggcaucaagcuuaccauggacuggaccuggauccuguuccucguggccgccgcgacccgcguccacagcagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagacguacaacugccuggugcaguacaaggcgaaguggaugaugaacuuccucaucaucuacaucuuccugauccugaucaaggacuccgccaucgucgugcaggccgccggcaccgacuucacgaccugccucgagaccgagagcaucaacuggaacugcaccggccccuuccugaaccuggggaacugccagaagcagcagaagaaggagccguacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17188 - RNA, 4078 nt, Artificial Sequence
  mRNA product Design2 comprising derived and/or modified sequence from LACV(Human/78)__NC_004109.1__SP-GP_Gn-4aa-Gc (opt1)
ggggcgcugccuacggagguggcagccaucuccuucucggcaucaagcuuaccaugaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcuacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17189 - RNA, 4093 nt, Artificial Sequence
  mRNA product Design2 comprising derived and/or modified sequence from LACV(Human/78)__NC_004109.1__IgE-leader_Gn-4aa-Gc (opt1)
ggggcgcugccuacggagguggcagccaucuccuucucggcaucaagcuuaccauggacuggaccuggauccuguuccucguggccgccgcgacccgcguccacagcagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcuacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17190 - RNA, 1090 nt, Artificial Sequence
  mRNA product Design2 comprising derived and/or modified sequence from LACV(Human/78)__NC_004109.1__N (opt5)
ggggcgcugccuacggagguggcagccaucuccuucucggcaucaagcuuaccaugagcgaccugguguucuacgaugucgccuccaccggcgcuaacggguuugaccccgaugccggauauauggacuucugcguuaagaaugcggagcuccugaaccuugcugccgugagaaucuuuuuccugaaugccgcuaaagccaaggcugcccucucucggaaaccugaacgcaaggcgaacccgaaauuuggcgaguggcaaguggaagucauuaauaaccacuuccccgggaauagaaacaauccuaucggaaacaaugaucugacaauucaucggcuuagcggcuaccuggcccgcugggugcucgaccaguauaacgagaaugaugacgaaucccagcacgagcugaucagaacgaccauuaucaaccccaucgcugagucuaaugggguuggaugggauagcggcccugaaauuuaccuguccuuuuuccccggcacagagauguuucucgaaaccuucaaguuuuauccucugacaaucgggauucaucgggugaagcagggaaugauggacccgcaguaccuuaaaaaggcccugcgccaaagauauggcacccucacagcugauaaauggaugucucagaaggucgccgcgaucgccaaaagccugaaggacguggagcagcuuaagugggggaaaggaggccuguccgauaccgcuaagacguuccuccagaaauuugggauucggcugcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17191 - RNA, 4708 nt, Artificial Sequence
  mRNA product Design2 comprising derived and/or modified sequence from LACV(Human/78)__NC_004109.1__GP (opt5)
ggggcgcugccuacggagguggcagccaucuccuucucggcaucaagcuuaccaugaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagagucaugugcaaauccaagggcccggccucuauccuuagcaucauuacggcugugcugguucucaccuucgugacacccaucaacuccaugguccugggggaaagcaaagagaccuuugagcuugaagaucugccugacgacaugcucgagauggccucucggauuaauuccuauuaccugacauguauccugaacuaugcugugagcuggggacucgucauuaucggccugcuuauuggccuccuguucaagaaguaccaacaccgcuuucugaauguguaugccauguacugcgaagagugugauauguaccacgacaaaucugggcuuaagagacauggagauuucaccaacaaaugccggcaguguacgugcggccaguaugaagacgccgcugggcugauggcgcaccgcaagacauacaauugccucguucaguauaaagccaaguggaugaugaacuuccugaucaucuacauuuuucugauccucauuaaggauagcgcuaucgugguccaagccgccggaaccgacuucaccacaugucuggagaccgaguccauuaacuggaauugcacaggccccuuucuuaaccuggggaauugucagaaacagcaaaagaaagaaccuuauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauugccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaaacuugcuaucucuuccaaaagcauuaagacauguaaaaaugugaaggacguugccugccugucuccucgcuccggcgccaucuaugcuagcauuaucgcguguggagaaccgaacggccccucugucuaccggaagccuagcgggggaguguuccaguccagcaccgauagaucuauuuauugccuccuggacucccauugccuggaggaguuugaagccaucggccaagaggaacuugaugcugugaaaaagagcaaauguugggagauugaguaccccgacgucaagcucauccaggaaggggacggaacaaaauccugccgcaugaaggauucuggcaauuguaacguggccaccaaucgguggccuguuauccagugcgagaacgacaaguucuacuauagcgaacugcagaaagauuacgacaaggcccaagauauugggcacuauugucugucccccggcugcaccacagugagauacccgaucaauccuaaacauauuucuaacuguaauuggcaggucagccgcuccucuaucgcuaagauugacgugcacaacaucgaggauaucgaacaguauaaaaaggccauuacgcagaagcuccaaaccagccugucccuuuuuaaauacgcgaagacaaagaaucugccccacaucaagccuauuuauaaauacaucaccauugagggaacagagaccgcugaaggcaucgagagcgccuacaucgaaucugagguucccgcccucgcugggacguccauuggauucaagaucaacagcaaagaaggcaagcaucugcuggacgugauugccuaugucaagucugcguccuacagcucuguguauacaaaacuuuacuccaccgggccuaccagcggaaucaauacaaagcacgaugagcucugcaccggccccuguccggcuaacauuaaucaucagguuggguggcugacauuugcccgggagagaacguccagcuggggcugcgaagaguucggaugucuggccgugucugacggcugcgucuuugggagcugccaggauaucauuaaagaggaacucuccguguaucgcaaggaaaccgaggaggugacagacgucgaacugugucuuaccuucucugauaaaacauacugcaccaaccugaacccuguuacgcccaucaucaccgaccucuuugaggugcaauucaagacaguggaaaccuauagccugccccggauugucgcugugcagaaucacgagaucaagauuggacagaucaacgaccugggcguuuacuccaaaggguguggaaaugugcagaaggucaacggcacaauuuacgggaauggcgugccuagauuugauuaucuuugccaucuggccucucggaaagagguuaucgugcgcaaguguuucgacaacgauuaccaggcuugcaaauuucuccaaagcccggccuccuauagacuggaagaggacucuggaaccgucacaaucauugauuacaagaagauccucggcaccauuaaaaugaaggcgauccugggggacgugaaauauaagacguucgccgauagcguugacauuacagcugaaggauccuguaccggcugcaucaauuguuucgagaacauccacugcgaacuuacccugcacacaaccauugaggccagcugucccaucaaaucuuccugcacgguguuucaugaucggauucucgucacaccuaaugagcacaaguacgcucugaagauggugugcaccgaaaaacccgggaacacacugaccaucaagguguguaauacaaaagucgaggccagcauggcccuuguugacgcuaagccuauuaucgaacuggcgcccguggaucagaccgccuauauuagagagaaagacgaacgcugcaagacguggaugugucgggugagagacgagggacuccaggucauccuggagccuuucaagaaccucuuuggcucuuacaucggcauuuucuacaccuuuaucauuuccaucgugguucugcuugugauuaucuauguccugcuccccaucugcuucaaacugcgcgauacacugagaaagcaugaagacgcuuacaaacgggagaugaagauucgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17192 - RNA, 4723 nt, Artificial Sequence
  mRNA product Design2 comprising derived and/or modified sequence from LACV(Human/78)__NC_004109.1__IgE-leader_Gn-NSm-Gc (opt5)
ggggcgcugccuacggagguggcagccaucuccuucucggcaucaagcuuaccauggacuggaccuggauccuguuccucguggccgcugcaacaagaguccacagcagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagagucaugugcaaauccaagggcccggccucuauccuuagcaucauuacggcugugcugguucucaccuucgugacacccaucaacuccaugguccugggggaaagcaaagagaccuuugagcuugaagaucugccugacgacaugcucgagauggccucucggauuaauuccuauuaccugacauguauccugaacuaugcugugagcuggggacucgucauuaucggccugcuuauuggccuccuguucaagaaguaccaacaccgcuuucugaauguguaugccauguacugcgaagagugugauauguaccacgacaaaucugggcuuaagagacauggagauuucaccaacaaaugccggcaguguacgugcggccaguaugaagacgccgcugggcugauggcgcaccgcaagacauacaauugccucguucaguauaaagccaaguggaugaugaacuuccugaucaucuacauuuuucugauccucauuaaggauagcgcuaucgugguccaagccgccggaaccgacuucaccacaugucuggagaccgaguccauuaacuggaauugcacaggccccuuucuuaaccuggggaauugucagaaacagcaaaagaaagaaccuuauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauugccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaaacuugcuaucucuuccaaaagcauuaagacauguaaaaaugugaaggacguugccugccugucuccucgcuccggcgccaucuaugcuagcauuaucgcguguggagaaccgaacggccccucugucuaccggaagccuagcgggggaguguuccaguccagcaccgauagaucuauuuauugccuccuggacucccauugccuggaggaguuugaagccaucggccaagaggaacuugaugcugugaaaaagagcaaauguugggagauugaguaccccgacgucaagcucauccaggaaggggacggaacaaaauccugccgcaugaaggauucuggcaauuguaacguggccaccaaucgguggccuguuauccagugcgagaacgacaaguucuacuauagcgaacugcagaaagauuacgacaaggcccaagauauugggcacuauugucugucccccggcugcaccacagugagauacccgaucaauccuaaacauauuucuaacuguaauuggcaggucagccgcuccucuaucgcuaagauugacgugcacaacaucgaggauaucgaacaguauaaaaaggccauuacgcagaagcuccaaaccagccugucccuuuuuaaauacgcgaagacaaagaaucugccccacaucaagccuauuuauaaauacaucaccauugagggaacagagaccgcugaaggcaucgagagcgccuacaucgaaucugagguucccgcccucgcugggacguccauuggauucaagaucaacagcaaagaaggcaagcaucugcuggacgugauugccuaugucaagucugcguccuacagcucuguguauacaaaacuuuacuccaccgggccuaccagcggaaucaauacaaagcacgaugagcucugcaccggccccuguccggcuaacauuaaucaucagguuggguggcugacauuugcccgggagagaacguccagcuggggcugcgaagaguucggaugucuggccgugucugacggcugcgucuuugggagcugccaggauaucauuaaagaggaacucuccguguaucgcaaggaaaccgaggaggugacagacgucgaacugugucuuaccuucucugauaaaacauacugcaccaaccugaacccuguuacgcccaucaucaccgaccucuuugaggugcaauucaagacaguggaaaccuauagccugccccggauugucgcugugcagaaucacgagaucaagauuggacagaucaacgaccugggcguuuacuccaaaggguguggaaaugugcagaaggucaacggcacaauuuacgggaauggcgugccuagauuugauuaucuuugccaucuggccucucggaaagagguuaucgugcgcaaguguuucgacaacgauuaccaggcuugcaaauuucuccaaagcccggccuccuauagacuggaagaggacucuggaaccgucacaaucauugauuacaagaagauccucggcaccauuaaaaugaaggcgauccugggggacgugaaauauaagacguucgccgauagcguugacauuacagcugaaggauccuguaccggcugcaucaauuguuucgagaacauccacugcgaacuuacccugcacacaaccauugaggccagcugucccaucaaaucuuccugcacgguguuucaugaucggauucucgucacaccuaaugagcacaaguacgcucugaagauggugugcaccgaaaaacccgggaacacacugaccaucaagguguguaauacaaaagucgaggccagcauggcccuuguugacgcuaagccuauuaucgaacuggcgcccguggaucagaccgccuauauuagagagaaagacgaacgcugcaagacguggaugugucgggugagagacgagggacuccaggucauccuggagccuuucaagaaccucuuuggcucuuacaucggcauuuucuacaccuuuaucauuuccaucgugguucugcuugugauuaucuauguccugcuccccaucugcuucaaacugcgcgauacacugagaaagcaugaagacgcuuacaaacgggagaugaagauucgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17193 - RNA, 4078 nt, Artificial Sequence
  mRNA product Design2 comprising derived and/or modified sequence from LACV(Human/78)__NC_004109.1__SP-GP_Gn-4aa-Gc (opt5)
ggggcgcugccuacggagguggcagccaucuccuucucggcaucaagcuuaccaugaucugcauucuggugcucaucaccgucgccgcugccagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagauauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauugccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaaacuugcuaucucuuccaaaagcauuaagacauguaaaaaugugaaggacguugccugccugucuccucgcuccggcgccaucuaugcuagcauuaucgcguguggagaaccgaacggccccucugucuaccggaagccuagcgggggaguguuccaguccagcaccgauagaucuauuuauugccuccuggacucccauugccuggaggaguuugaagccaucggccaagaggaacuugaugcugugaaaaagagcaaauguugggagauugaguaccccgacgucaagcucauccaggaaggggacggaacaaaauccugccgcaugaaggauucuggcaauuguaacguggccaccaaucgguggccuguuauccagugcgagaacgacaaguucuacuauagcgaacugcagaaagauuacgacaaggcccaagauauugggcacuauugucugucccccggcugcaccacagugagauacccgaucaauccuaaacauauuucuaacuguaauuggcaggucagccgcuccucuaucgcuaagauugacgugcacaacaucgaggauaucgaacaguauaaaaaggccauuacgcagaagcuccaaaccagccugucccuuuuuaaauacgcgaagacaaagaaucugccccacaucaagccuauuuauaaauacaucaccauugagggaacagagaccgcugaaggcaucgagagcgccuacaucgaaucugagguucccgcccucgcugggacguccauuggauucaagaucaacagcaaagaaggcaagcaucugcuggacgugauugccuaugucaagucugcguccuacagcucuguguauacaaaacuuuacuccaccgggccuaccagcggaaucaauacaaagcacgaugagcucugcaccggccccuguccggcuaacauuaaucaucagguuggguggcugacauuugcccgggagagaacguccagcuggggcugcgaagaguucggaugucuggccgugucugacggcugcgucuuugggagcugccaggauaucauuaaagaggaacucuccguguaucgcaaggaaaccgaggaggugacagacgucgaacugugucuuaccuucucugauaaaacauacugcaccaaccugaacccuguuacgcccaucaucaccgaccucuuugaggugcaauucaagacaguggaaaccuauagccugccccggauugucgcugugcagaaucacgagaucaagauuggacagaucaacgaccugggcguuuacuccaaaggguguggaaaugugcagaaggucaacggcacaauuuacgggaauggcgugccuagauuugauuaucuuugccaucuggccucucggaaagagguuaucgugcgcaaguguuucgacaacgauuaccaggcuugcaaauuucuccaaagcccggccuccuauagacuggaagaggacucuggaaccgucacaaucauugauuacaagaagauccucggcaccauuaaaaugaaggcgauccugggggacgugaaauauaagacguucgccgauagcguugacauuacagcugaaggauccuguaccggcugcaucaauuguuucgagaacauccacugcgaacuuacccugcacacaaccauugaggccagcugucccaucaaaucuuccugcacgguguuucaugaucggauucucgucacaccuaaugagcacaaguacgcucugaagauggugugcaccgaaaaacccgggaacacacugaccaucaagguguguaauacaaaagucgaggccagcauggcccuuguugacgcuaagccuauuaucgaacuggcgcccguggaucagaccgccuauauuagagagaaagacgaacgcugcaagacguggaugugucgggugagagacgagggacuccaggucauccuggagccuuucaagaaccucuuuggcucuuacaucggcauuuucuacaccuuuaucauuuccaucgugguucugcuugugauuaucuauguccugcuccccaucugcuucaaacugcgcgauacacugagaaagcaugaagacgcuuacaaacgggagaugaagauucgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17194 - RNA, 4093 nt, Artificial Sequence
  mRNA product Design2 comprising derived and/or modified sequence from LACV(Human/78)__NC_004109.1__IgE-leader_Gn-4aa-Gc (opt5)
ggggcgcugccuacggagguggcagccaucuccuucucggcaucaagcuuaccauggacuggaccuggauccuguuccucguggccgcugcaacaagaguccacagcagccccguuuaccagagauguuuccaagacggcgcgauugugaagcagaacccuuccaaagaggcugugacagaagucugccugaaggaugacgugucuaugaucaaaacggaggcccgguauguucgcaaugccaccgggguguuuagcaacaaugucgcuauuagaaaguggcuuguguccgauuggcacgacugucggccgaaaaagaucguuggaggccauaucaacgugauugaagucggggaugaccugucucuccacacagagagcuacgugugcuccgccgauuguaccaucggaguggacaaggaaacagcucagguccgccugcagaccgauacaaccaaucauuucgagauugccggcacgaccguuaaaucugggugguuuaagagcacaaccuauaucacacuugaccaaaccugcgagcaccugaaaguguccuguggacccaagagcgugcaguuccaugcgugcuuuaaccagcacaugucuugugucagauuccuccaccggacgauucugccuggcuccaucgccaauagcauuugccagaacaucgaaaucauuauccuggugacacucacccugcuuauuuuuauccugcucucuauucuguccaaaacauacaucuguuaucuucugaugcccaucuucauuccuaucgcuuacauuuauggcaucauuuacaauaagagcugcaagaaaugcaagcucugugggcugguuuaccaucccuuuaccgagugcggaacccacugugugugcggcgcccgcuaugauacaucugacagaaugaaacugcaucgggcuuccgggcucuguccuggauacaagagccugcgcgccgcgagauauacgaacaucgcuacccagcucaagggacugaaagccaucucugugcuggauguucccauuaucacaggcauuccggacgauaucgcgggcgcucuuagauacauugaggaaaaggaggacuuccaugugcagcucaccaucgaauaugccaugcugagcaaguacugcgauuacuauacacaguuuuccgacaauagcggguacucucaaaccacguggcgggucuaucugagaucccacgacuucgaggccuguauccucuacccuaaccagcauuuuugccgcugugugaaaaauggagagaagugcucuagcuccaacugggauuucgcuaaugaaaugaaagacuauuacagcggcaagcagaccaaauuugauaaggaccugaaccuugcccugacagcucuccaccacgccuuccgggggaccuccucugcguauauugccacaaugcugagcaagaaauccaaugaugaccugaucgcuuacaccaacaagauuaaaacgaaguuucccggaaaugcccuucucaaagcuaucauugauuacaucgccuauaugaagucucugccuggcauggcgaacuucaaauacgacgaguuuugggaugaacugcucuauaagcccaaucccgccaaggcuagcaaccuggccagagggaaagaguccagcuacaacuucaaacuugcuaucucuuccaaaagcauuaagacauguaaaaaugugaaggacguugccugccugucuccucgcuccggcgccaucuaugcuagcauuaucgcguguggagaaccgaacggccccucugucuaccggaagccuagcgggggaguguuccaguccagcaccgauagaucuauuuauugccuccuggacucccauugccuggaggaguuugaagccaucggccaagaggaacuugaugcugugaaaaagagcaaauguugggagauugaguaccccgacgucaagcucauccaggaaggggacggaacaaaauccugccgcaugaaggauucuggcaauuguaacguggccaccaaucgguggccuguuauccagugcgagaacgacaaguucuacuauagcgaacugcagaaagauuacgacaaggcccaagauauugggcacuauugucugucccccggcugcaccacagugagauacccgaucaauccuaaacauauuucuaacuguaauuggcaggucagccgcuccucuaucgcuaagauugacgugcacaacaucgaggauaucgaacaguauaaaaaggccauuacgcagaagcuccaaaccagccugucccuuuuuaaauacgcgaagacaaagaaucugccccacaucaagccuauuuauaaauacaucaccauugagggaacagagaccgcugaaggcaucgagagcgccuacaucgaaucugagguucccgcccucgcugggacguccauuggauucaagaucaacagcaaagaaggcaagcaucugcuggacgugauugccuaugucaagucugcguccuacagcucuguguauacaaaacuuuacuccaccgggccuaccagcggaaucaauacaaagcacgaugagcucugcaccggccccuguccggcuaacauuaaucaucagguuggguggcugacauuugcccgggagagaacguccagcuggggcugcgaagaguucggaugucuggccgugucugacggcugcgucuuugggagcugccaggauaucauuaaagaggaacucuccguguaucgcaaggaaaccgaggaggugacagacgucgaacugugucuuaccuucucugauaaaacauacugcaccaaccugaacccuguuacgcccaucaucaccgaccucuuugaggugcaauucaagacaguggaaaccuauagccugccccggauugucgcugugcagaaucacgagaucaagauuggacagaucaacgaccugggcguuuacuccaaaggguguggaaaugugcagaaggucaacggcacaauuuacgggaauggcgugccuagauuugauuaucuuugccaucuggccucucggaaagagguuaucgugcgcaaguguuucgacaacgauuaccaggcuugcaaauuucuccaaagcccggccuccuauagacuggaagaggacucuggaaccgucacaaucauugauuacaagaagauccucggcaccauuaaaaugaaggcgauccugggggacgugaaauauaagacguucgccgauagcguugacauuacagcugaaggauccuguaccggcugcaucaauuguuucgagaacauccacugcgaacuuacccugcacacaaccauugaggccagcugucccaucaaaucuuccugcacgguguuucaugaucggauucucgucacaccuaaugagcacaaguacgcucugaagauggugugcaccgaaaaacccgggaacacacugaccaucaagguguguaauacaaaagucgaggccagcauggcccuuguugacgcuaagccuauuaucgaacuggcgcccguggaucagaccgccuauauuagagagaaagacgaacgcugcaagacguggaugugucgggugagagacgagggacuccaggucauccuggagccuuucaagaaccucuuuggcucuuacaucggcauuuucuacaccuuuaucauuuccaucgugguucugcuugugauuaucuauguccugcuccccaucugcuucaaacugcgcgauacacugagaaagcaugaagacgcuuacaaacgggagaugaagauucgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17195 - RNA, 1090 nt, Artificial Sequence
  mRNA product Design2 comprising derived and/or modified sequence from LACV(Human/78)__NC_004109.1__N (opt11)
ggggcgcugccuacggagguggcagccaucuccuucucggcaucaagcuuaccauguccgaccucguauucuacgacguagccucaacaggcgccaacggauucgacccagacgccggauacauggacuucugcgucaaaaacgccgaacuccucaaccucgccgccguccgcaucuucuuccucaacgccgccaaagccaaagcagcccuaucccgcaaacccgaacgaaaagccaaccccaaauucggcgaauggcaagucgaagucaucaacaaccacuuccccggcaaccgcaacaacccaaucggcaacaacgaccucaccauacaccgacuuuccggcuaccucgcccgauggguccucgaccaauacaacgaaaacgacgacgaaucccaacacgaacuaauacgcacaaccaucaucaaccccaucgccgaguccaacggcgucggcugggacuccggacccgaaauauaccucuccuucuuccccggcacagaaauguuccuagaaaccuucaaauucuacccacucacuaucggcauccacagaguaaaacaaggaaugauggacccccaauaccucaaaaaagcccuacgacaacgcuacggaacccuuaccgccgacaaauggaugucacaaaaagucgccgccaucgccaaaucccucaaagacguagaacaacucaaauggggaaaaggcggccucucagacaccgccaaaaccuuccuccaaaaauucggcauccgacucccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17196 - RNA, 4708 nt, Artificial Sequence; identical to SEQ ID NO: 17186
  mRNA product Design2 comprising derived and/or modified sequence from LACV(Human/78)__NC_004109.1__GP (opt11)

SEQ ID NO: 17197 - RNA, 4723 nt, Artificial Sequence
  mRNA product Design2 comprising derived and/or modified sequence from LACV(Human/78)__NC_004109.1__IgE-leader_Gn-NSm-Gc (opt11)
ggggcgcugccuacggagguggcagccaucuccuucucggcaucaagcuuaccauggacuggaccuggauccuguuccucguggccgcugcaacaagaguccacagcagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagacguacaacugccuggugcaguacaaggcgaaguggaugaugaacuuccucaucaucuacaucuuccugauccugaucaaggacuccgccaucgucgugcaggccgccggcaccgacuucacgaccugccucgagaccgagagcaucaacuggaacugcaccggccccuuccugaaccuggggaacugccagaagcagcagaagaaggagccguacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17198 - RNA, 4078 nt, Artificial Sequence; identical to SEQ ID NO: 17188
  mRNA product Design2 comprising derived and/or modified sequence from LACV(Human/78)__NC_004109.1__SP-GP_Gn-4aa-Gc (opt11)

SEQ ID NO: 17199 - RNA, 4093 nt, Artificial Sequence
  mRNA product Design2 comprising derived and/or modified sequence from LACV(Human/78)__NC_004109.1__IgE-leader_Gn-4aa-Gc (opt11)
ggggcgcugccuacggagguggcagccaucuccuucucggcaucaagcuuaccauggacuggaccuggauccuguuccucguggccgcugcaacaagaguccacagcagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcuacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17200 - protein, 245 aa, Artificial Sequence; identical to SEQ ID NO: 853
  derived and/or modified protein sequence (wt) from RVFV(ZH-548)__DQ380151.1__N

SEQ ID NO: 17201 - protein, 1197 aa, Artificial Sequence; identical to SEQ ID NO: 2009
  derived and/or modified protein sequence (wt) from RVFV(ZH-548)__DQ380206.1__GP

SEQ ID NO: 17202 - protein, 1067 aa, Artificial Sequence; identical to SEQ ID NO: 2159
  derived and/or modified protein sequence (wt) from RVFV(ZH-548)__DQ380206.1__Gn-Gc

SEQ ID NO: 17203 - protein, 984 aa, Artificial Sequence
  derived and/or modified protein sequence (wt) from RVFV(ZH-548)__DQ380206.1__Gne_SP-Gn_Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTAMAGIAMTVLPALAVFALAPVVFAEDCSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 17204 - protein, 1062 aa, Artificial Sequence
  derived and/or modified protein sequence (wt) from RVFV(ZH-548)__DQ380206.1__IgE-leader_Gn(delSP)-Gc-variant1
MDWTWILFLVAAATRVHSEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 17205 - protein, 1060 aa, Artificial Sequence
  derived and/or modified protein sequence (wt) from RVFV(ZH-548)__DQ380206.1__IgE-leader_Gn(delSP)-Gc-variant2
MDWTWILFLVAAATRVHSPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 17206 - protein, 555 aa, Artificial Sequence
  derived and/or modified protein sequence (wt) from RVFV(ZH-548)__DQ380206.1__IgE-leader_Gn(delSP)-variant1
MDWTWILFLVAAATRVHSEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASA

SEQ ID NO: 17207 - protein, 553 aa, Artificial Sequence
  derived and/or modified protein sequence (wt) from RVFV(ZH-548)__DQ380206.1__IgE-leader_Gn(delSP)-variant2
MDWTWILFLVAAATRVHSPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASA

SEQ ID NO: 17208 - protein, 525 aa, Artificial Sequence
  derived and/or modified protein sequence (wt) from RVFV(ZH-548)__DQ380206.1__IgE-leader_Gc
MDWTWILFLVAAATRVHSCSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 17209 - RNA, 738 nt, Artificial Sequence; identical to SEQ ID NO: 3188
  derived and/or modified CDS sequence (wt) from RVFV(ZH-548)__DQ380151.1__N

SEQ ID NO: 17210 - RNA, 738 nt, Artificial Sequence
  derived and/or modified CDS sequence (wt) from RVFV(ZH-548)__DQ380151.1__N
auggacaacuaucaagagcuugcgauccaguuugcugcucaagcaguggaccgcaaugagauugaacaguggguccgagaguuugcuuaucaaggguuugaugcccguagaguuaucgaacucuuaaagcaguaugguggggcugacugggagaaggaugccaagaaaaugauuguucuggcucuaacucguggcaacaagcccaggaggaugaugaugaaaaugucgaaagaaggcaaagcaacuguggaggcucucaucaacaaguauaagcuaaaggaagggaauccuucccgggaugaguugacucuaucacgaguugcugccgccuuggcuggcuggacaugccaggcuuuggucgucuugagugaguggcuuccugucacugggacuaccauggacggccuauccccugcauacccgaggcauaugaugcaccccagcuuugcuggcaugguggauccuucucuaccaggagacuaucuaagggcaauauuagaugcucacucucuguaucugcugcaguucucccgggucaucaacccaaaccuccgagguagaacaaaagaggagguugcugcaacguucacgcagccaaugaaugcagcagugaauagcaacuuuauaagccaugagaagaggagagaguucuugaaagccuuuggacuuguggauuccaaugggaagccgucagcugcugucauggcagccgcucaggcuuacaagacagcagccuaa

SEQ ID NO: 17211 - RNA, 3594 nt, Artificial Sequence; identical to SEQ ID NO: 4344
  derived and/or modified CDS sequence (wt) from RVFV(ZH-548)__DQ380206.1__GP

SEQ ID NO: 17212 - RNA, 3594 nt, Artificial Sequence
  derived and/or modified CDS sequence (wt) from RVFV(ZH-548)__DQ380206.1__GP
auguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugucaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 17213 - RNA, 3204 nt, Artificial Sequence; identical to SEQ ID NO: 4494
  derived and/or modified CDS sequence (wt) from RVFV(ZH-548)__DQ380206.1__Gn-Gc

SEQ ID NO: 17214 - RNA, 3204 nt, Artificial Sequence
  derived and/or modified CDS sequence (wt) from RVFV(ZH-548)__DQ380206.1__Gn-Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 17215 - RNA, 2955 nt, Artificial Sequence
  derived and/or modified CDS sequence (wt) from RVFV(ZH-548)__DQ380206.1__Gne_SP-Gn_Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcuauggcagggauugcaaugacaguccuuccagccuuagcaguuuuugcuuuggcaccuguuguuuuugcugaagacuguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 17216 - RNA, 2955 nt, Artificial Sequence
  derived and/or modified CDS sequence (wt) from RVFV(ZH-548)__DQ380206.1__Gne_SP-Gn_Gc
auggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcuauggcagggauugcaaugacaguccuuccagccuuagcaguuuuugcuuuggcaccuguuguuuuugcugaagacuguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 17217 - RNA, 3189 nt, Artificial Sequence
  derived and/or modified CDS sequence (wt) from RVFV(ZH-548)__DQ380206.1__IgE-leader_Gn(delSP)-Gc-variant1
auggacuggaccuggauccuguuccucguggccgccgcgacccgcguccacagcgaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 17218 - RNA, 3189 nt, Artificial Sequence
  derived and/or modified CDS sequence (wt) from RVFV(ZH-548)__DQ380206.1__IgE-leader_Gn(delSP)-Gc-variant1
auggacuggaccuggauccuguuccucguggccgccgcgacccgcguccacagcgaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 17219 - RNA, 3183 nt, Artificial Sequence
  derived and/or modified CDS sequence (wt) from RVFV(ZH-548)__DQ380206.1__IgE-leader_Gn(delSP)-Gc-variant2
auggacuggaccuggauccuguuccucguggccgccgcgacccgcguccacagcccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 17220 - RNA, 3183 nt, Artificial Sequence
  derived and/or modified CDS sequence (wt) from RVFV(ZH-548)__DQ380206.1__IgE-leader_Gn(delSP)-Gc-variant2
auggacuggaccuggauccuguuccucguggccgccgcgacccgcguccacagcccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 17221 - RNA, 1668 nt, Artificial Sequence
  derived and/or modified CDS sequence (wt) from RVFV(ZH-548)__DQ380206.1__IgE-leader_Gn(delSP)-variant1
auggacuggaccuggauccuguuccucguggccgccgcgacccgcguccacagcgaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauag

SEQ ID NO: 17222 - RNA, 1668 nt, Artificial Sequence
  derived and/or modified CDS sequence (wt) from RVFV(ZH-548)__DQ380206.1__IgE-leader_Gn(delSP)-variant1
auggacuggaccuggauccuguuccucguggccgccgcgacccgcguccacagcgaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauag

SEQ ID NO: 17223 - RNA, 1662 nt, Artificial Sequence
  derived and/or modified CDS sequence (wt) from RVFV(ZH-548)__DQ380206.1__IgE-leader_Gn(delSP)-variant2
auggacuggaccuggauccuguuccucguggccgccgcgacccgcguccacagcccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauag

SEQ ID NO: 17224 - RNA, 1662 nt, Artificial Sequence
  derived and/or modified CDS sequence (wt) from RVFV(ZH-548)__DQ380206.1__IgE-leader_Gn(delSP)-variant2
auggacuggaccuggauccuguuccucguggccgccgcgacccgcguccacagcccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauag

SEQ ID NO: 17225 - RNA, 1578 nt, Artificial Sequence
  derived and/or modified CDS sequence (wt) from RVFV(ZH-548)__DQ380206.1__IgE-leader_Gc
auggacuggaccuggauccuguuccucguggccgccgcgacccgcguccacagcuguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 17226 - RNA, 1578 nt, Artificial Sequence
  derived and/or modified CDS sequence (wt) from RVFV(ZH-548)__DQ380206.1__IgE-leader_Gc
auggacuggaccuggauccuguuccucguggccgccgcgacccgcguccacagcuguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauag

SEQ ID NO: 17227 - RNA, 738 nt, Artificial Sequence; identical to SEQ ID NO: 5523
  derived and/or modified CDS sequence (opt4) from RVFV(ZH-548)__DQ380151.1__N

SEQ ID NO: 17228 - RNA, 3594 nt, Artificial Sequence
  derived and/or modified CDS sequence (opt4) from RVFV(ZH-548)__DQ380206.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugucacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 17229 - RNA, 3204 nt, Artificial Sequence
  derived and/or modified CDS sequence (opt4) from RVFV(ZH-548)__DQ380206.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 17230 - RNA, 2955 nt, Artificial Sequence
  derived and/or modified CDS sequence (opt4) from RVFV(ZH-548)__DQ380206.1__Gne_SP-Gn_Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgccauggccggcaucgccaugaccgugcugcccgcccuggccguguucgcccuggcccccgugguguucgccgaggacugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 17231 - RNA, 3189 nt, Artificial Sequence
  derived and/or modified CDS sequence (opt4) from RVFV(ZH-548)__DQ380206.1__IgE-leader_Gn(delSP)-Gc-variant1
auggacuggaccuggauccuguuccugguggccgccgccaccagagugcacagcgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 17232 - RNA, 3183 nt, Artificial Sequence
  derived and/or modified CDS sequence (opt4) from RVFV(ZH-548)__DQ380206.1__IgE-leader_Gn(delSP)-Gc-variant2
auggacuggaccuggauccuguuccugguggccgccgccaccagagugcacagcccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 17233 - RNA, 1668 nt, Artificial Sequence
  derived and/or modified CDS sequence (opt4) from RVFV(ZH-548)__DQ380206.1__IgE-leader_Gn(delSP)-variant1
auggacuggaccuggauccuguuccugguggccgccgccaccagagugcacagcgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccuga

SEQ ID NO: 17234 - RNA, 1662 nt, Artificial Sequence
  derived and/or modified CDS sequence (opt4) from RVFV(ZH-548)__DQ380206.1__IgE-leader_Gn(delSP)-variant2
auggacuggaccuggauccuguuccugguggccgccgccaccagagugcacagcccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccuga

SEQ ID NO: 17235 - RNA, 1578 nt, Artificial Sequence
  derived and/or modified CDS sequence (opt4) from RVFV(ZH-548)__DQ380206.1__IgE-leader_Gc
auggacuggaccuggauccuguuccugguggccgccgccaccagagugcacagcugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 17236 - RNA, 738 nt, Artificial Sequence; identical to SEQ ID NO: 6215
  derived and/or modified CDS sequence (opt3) from RVFV(ZH-548)__DQ380151.1__N

SEQ ID NO: 17237 - RNA, 3594 nt, Artificial Sequence; identical to SEQ ID NO: 11090
  derived and/or modified CDS sequence (opt3) from RVFV(ZH-548)__DQ380206.1__GP

SEQ ID NO: 17238 - RNA, 3204 nt, Artificial Sequence; identical to SEQ ID NO: 11240
  derived and/or modified CDS sequence (opt3) from RVFV(ZH-548)__DQ380206.1__Gn-Gc

SEQ ID NO: 17239 - RNA, 2955 nt, Artificial Sequence
  derived and/or modified CDS sequence (opt3) from RVFV(ZH-548)__DQ380206.1__Gne_SP-Gn_Gc
auggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcuuagugcgcauggaaacccuuguaugaaagagaagcuggugaugaagacucacugcccaaaugauuaucagagcgcacacuacuugaacaaugacggcaaaauggccuccguuaagugucccccuaaauaugaacucaccgaggauugcaacuuuugucgccagaugacaggugcuucucugaagaaagggucguacccacugcaggaccucuucugccaaucaagcgaggaugacggaaguaaguuaaagaccaaaaugaagggcgugugugaagucggcgugcaggcccugaaaaagugcgaugggcagcuuuccacugcacaugagguaguuccguuugcuguguucaaaaauucuaagaaagucuauuuggacaagcuggaccuaaagacagaagagaaccuccugcccgauagcuuuguguguuucgagcacaaaggacaguacaaggguaccauggacuccggccaaacgaaacgagaacuuaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcagauccaagucagcggcguuuggaaaaagccacugugcgugggcuaugaacguguaguggucaaaagagaguugagugccaagcccauacagaggguggaaccuuguacaacuugcaucaccaaaugugagccacacgggcucguugugcggucuacaggauuuaagauuuccagcgcagucgccugcgcuucggguguguguguaaccggcucucagucccccucaacggagaucacucugaaguacccggggauuagucaaagcuccggaggcgauaucgguguucauauggcgcacgacgaucagucugugagcucaaaaauagucgcacauugcccuccccaggacccauguuuagugcacgauugcauugucugcgcccaugggcugaucaauuaucagugucacacagcuauggccggcauugcaaugaccgugcucccugcccuugcuguuuucgcccuggcacccgugguauucgcggaagacugcagugaguugauccaagcuagcagccgcaucacuacauguucuaccgaaggagucaacacgaagugcagacuaucaggcaccgcccugauuagggcagggagugugggagccgaggcuugucucaugcugaaagguguuaaggaagaucagacaaaauuucuuaagauaaagacugugagcuccgagcugucuugccgggagggccagucguacuggaccgggagcuucuccccaaaauguuugucaagucgccgaugccaccucgucggagaaugucaugugaauagaugccugucuuggagggacaacgagacaagcgccgaauuuuccuucguaggcgagucaacuaccaugcgggaaaauaaguguuuugagcagugcgguggguggggcugcggauguuucaacgugaaccccagcugcuuauuuguucacacauaucugcaaucuguccguaaagaggcacuacgcguguucaauuguaucgacugggugcauaagcucacccuggaaauuacugauuuugacggcuccgucaguacgaucgaucuuggggcuuccucuuccagauucacaaacuggggaucaguuaguuugagccuggacgccgaggguauaucgggcuccaauucuuuuagcuucauugaaucaccugggaaaggauacgcgaucguggaugagccauuuagugagaucccgaggcagggcuuccucggugaaauucggugcaacuccgagucuagcgugcuguccgcccacgaaucaugucuucgagcucccaaucugaucagcuacaagccuaugauugaccaguuggagugcaccacuaaccucauagauccauucguagucuuugaacgcgggagucugccccagaccagaaaugacaaaacauucgcagccucuaagggcaacaggggagugcaggcuuuuuccaagggcagcguucaagccgauuuaacccugauguucgacaauuuugagguggauuucgucggggcagcggugucgugugacgccgcuuuucuaaaccucacuggaugcuauucauguaaugccggcgcacggguuugccugucuaucacaaguacggguaccgggucccuuagcgcucacaacaaagauggaucuuugcauauugugcugccuagcgagaauggcacuaaggaccagugucagauccuccacuucacaguaccagaagucgaggaagaguuuauguacuccugcgacggugaugaacgcccccuguuagugaaaggcacccugaucgccauugacccguucgaugacagaagggaggcagggggagagucaacaguggucaacccuaagaguggcagcuggaacuuuuucgauugguuuucugggcuuauguccugguucggaggcccauugaaaacuauacuccugaucugccuauauguugcccugucaauuggucucuucuuucugcuuaucuacuuggggcguaccggacugaguaagaugugguuagcugcgacgaagaaagccagcuga

SEQ ID NO: 17240 - RNA, 3189 nt, Artificial Sequence
  derived and/or modified CDS sequence (opt3) from RVFV(ZH-548)__DQ380206.1__IgE-leader_Gn(delSP)-Gc-variant1
auggacuggacauggauccuguuccucguggccgcugcaacaagaguccacagcgaggauccccaucuuaggaaccggccuggcaaggggcacaauuacauugacggaaugacucaggaagaugccacgugcaaaccaguuaccuaugcgggugcuuguuccucuuuugacgugcuguuggagaagggcaaauucccguuauuucaaucauacgcccaucaccgcacacugcuagaagcaguacaugauacuauaaucgccaaggcugaucccccuaguugcgaccuccugagcgcacacgggaacccauguaugaaagagaaacuugugaugaagacccacugccccaaugacuaucaguccgcccauuaccugaacaaugauggaaaaauggcuucugucaaguguccuccaaaauaugaauugacagaggacugcaacuucugucgacagaugaccggcgccucgcucaagaaagguucauacccccugcaggaucuguuuugccaaagcagugaggacgauggguccaagcucaagacuaaaaugaagggagugugugaaguuggcgugcaggcguuaaagaagugcgacggccagcugucuacagcacacgaggucgugccuuucgccguauuuaaaaauagcaagaaaguuuaucuugacaaguuggaucugaagaccgaagagaaccuacucccagacuccuucguguguuuugagcauaaagggcaguacaagggaacgauggauucaggucaaacuaaacgugaacugaagaguuucgacauuagccagugcccgaaaaucggcgggcacggaucuaagaagugcaccggcgaugcugccuuuuguuccgcauacgagugcacagcucaguaugccaaugcguacuguucacacgccaacgguagcgggauuguccagauccaagugaguggaguguggaaaaagccccuuugcgucggcuaugaaagaguugugguaaaaagggagcugucugcaaagccuauacagcggguggaaccauguacuaccugcaucacaaaaugugagccccauggcuuggucgugcgcuccaccggguucaagauuagcucggcuguugccugcgcuucuggagugugugucacggguucccagucaccuaguacugagaucacacucaaguacccaggcauuagccaauccucugggggagacaucggcgugcacauggcccaugaugaccagagcguaucaaguaaaauaguugcacacugucccccgcaggauccuugccuggugcaugacugcauugucugcgcccacgguuuaaucaauuaucagugucacaccgcucuguccgcguuuguggucguguucguuuucagcucuauugcaaucaucugccucgccauucuuuacagagugcugaaguguuugaaaauagcucccaggaagguacuaaacccacugauguggaucacugccuuuauucgguggaucuauaaaaagauggucgcacgcguggccgauaauauaaaccaaguuaaucgagaaauuggguggauggagggcggacagcucgugcugggcaacccugcucccaucccaagacaugcccccaucccuagguacucaacauaccuuaugcuguugcucauugucaguuaugcaagcgcgugcuccgaacugauccaggcuucuucgcggauuaccacguguagcaccgagggggugaacacaaagugccguuuauccggaacugcccugauacgcgcagguucaguaggcgccgaggcuugucuaaugcucaaaggggugaaggaagaccagaccaaauuccugaagaucaaaacaguuaguucugagcuuagcugcagagaaggacaauccuacuggacuggcucauuuagcccaaaguguuugucuuccaggcggugccaccuggucggugagugucaugugaaucgaugccucaguuggcgcgacaacgaaaccagcgccgaguucucuuuugugggggaauccacaaccaugagagagaauaaaugcuucgagcaguguggcggauggggcugcggguguuuuaacgucaauccgucaugccuguucguucacacuuaucuucagagugugaggaaggaagcacugcggguguuuaacuguauugauuggguacacaaguugacgcucgagaucacagacuucgauggaagcgucucgaccaucgaccugggugcuuccucuagccgcuuuacuaauuggggcucagugaguuuaucccuggaugccgaagggauuucuggaagcaacuccuucucauuuauagagagccccggcaaagguuacgcgaucguugacgagccuuucagugaaauuccaagacagggguuccuaggcgagaucaggugcaauucugaauccagcgugcucucggcccaugagucaugucugcgugcucccaaccuuauuucuuauaagccuaugaucgaucaauuggaaugcaccacaaaucugauagacccauuugucguguucgagcggggaagucucccccagacccgaaacgauaaaacuuuugcagccuccaagggcaauagagggguucaggcuuucagcaaaggaucugugcaggccgaccugacauuaauguuugauaacuucgagguagacuuugucggcgcagcggugagcugugaugccgcuuuccugaaucuuacggguugcuacuccuguaacgccggggcaagggugugcuugucaaucaccaguacuggaacaggcagccucucugcucacaacaaggacgguucccugcauauuguccuaccgucagaaaauggcaccaaggaccaaugccagauccugcacuuuacaguuccugagguggaagaggaguucauguauaguugugauggggacgaacgcccacuccugguaaaaggaacucuuauugccaucgaucccuuugacgaucggagagaggcaggcggggaaagcaccguggucaacccuaaguccggaucuuggaauuucuuugacugguucucgggcuugaugagcugguucggugggccccugaaaacgauauuacucauuugccuguacguggcccuuucaaucggacuguuuuucuugcucauuuaccugggcaggaccggucuauccaagauguggcuggcugcgaccaaaaaggccaguuga

SEQ ID NO: 17241 - RNA, 3183 nt, Artificial Sequence
  derived and/or modified CDS sequence (opt3) from RVFV(ZH-548)__DQ380206.1__IgE-leader_Gn(delSP)-Gc-variant2
auggacuggacauggauccuguuccucguggccgcugcaacaagaguccacagcccccaucuuaggaaccggccuggcaaggggcacaauuacauugauggaaugacucaggaggacgccacgugcaaaccaguuaccuaugcgggugcuuguuccucuuuugaugugcuguuggaaaagggcaaauucccguuauuucaaucauacgcccaucaccgcacacugcuagaggcaguacaugacacuauaaucgccaaggcugaucccccuaguugcgaccuccugagcgcacacgggaacccauguaugaaagaaaaacuugugaugaagacccacugccccaaugauuaucaguccgcccauuaccugaacaaugacggaaaaauggcuucugucaaguguccuccaaaauaugaguugacagaagauugcaacuucugucgacagaugaccggcgccucgcucaagaaagguucauacccccugcaggaccuguuuugccaaagcagugaggaugacggguccaagcucaagacuaaaaugaagggagugugugagguuggcgugcaggcguuaaagaagugcgauggccagcugucuacagcacacgaagucgugccuuucgccguauuuaaaaauagcaagaaaguuuaucuugacaaguuggaccugaagaccgaggaaaaccuacucccagauuccuucguguguuuugagcauaaagggcaguacaagggaacgauggacucaggucaaacuaaacgugagcugaagaguuucgauauuagccagugcccgaaaaucggcgggcacggaucuaagaagugcaccggcgacgcugccuuuuguuccgcauacgaaugcacagcucaguaugccaaugcguacuguucacacgccaacgguagcgggauuguccagauccaagugaguggaguguggaaaaagccccuuugcgucggcuaugagagaguugugguaaaaagggaacugucugcaaagccuauacagcggguggagccauguacuaccugcaucacaaaaugugaaccccauggcuuggucgugcgcuccaccggguucaagauuagcucggcuguugccugcgcuucuggagugugugucacggguucccagucaccuaguacugagaucacacucaaguacccaggcauuagccaauccucugggggagauaucggcgugcacauggcccaugacgaucagagcguaucaaguaaaauaguugcacacugucccccgcaggacccuugccuggugcaugauugcauugucugcgcccacgguuuaaucaauuaucagugucacaccgcucuguccgcguuuguggucguguucguuuucagcucuauugcaaucaucugccucgccauucuuuacagagugcugaaguguuugaaaauagcucccaggaagguacuaaacccacugauguggaucacugccuuuauucgguggaucuauaaaaagauggucgcacgcguggccgacaauauaaaccaaguuaaucgagagauuggguggauggaaggcggacagcucgugcugggcaacccugcucccaucccaagacaugcccccaucccuagguacucaacauaccuuaugcuguugcucauugucaguuaugcaagcgcgugcuccgagcugauccaggcuucuucgcggauuaccacguguagcaccgaaggggugaacacaaagugccguuuauccggaacugcccugauacgcgcagguucaguaggcgccgaggcuugucuaaugcucaaaggggugaaggaagaucagaccaaauuccugaagaucaaaacaguuaguucugagcuuagcugcagagagggacaauccuacuggacuggcucauuuagcccaaaguguuugucuuccaggcggugccaccuggucggugaaugucaugugaaucgaugccucaguuggcgcgacaacgagaccagcgccgaguucucuuuugugggggaauccacaaccaugagagaaaauaaaugcuucgagcaguguggcggauggggcugcggguguuuuaacgucaauccgucaugccuguucguucacacuuaucuucagagugugaggaaggaggcacugcggguguuuaacuguauugacuggguacacaaguugacgcucgaaaucacagauuucgacggaagcgucucgaccaucgaucugggugcuuccucuagccgcuuuacuaauuggggcucagugaguuuaucccuggacgccgaggggauuucuggaagcaacuccuucucauuuauagaaagccccggcaaagguuacgcgaucguugaugagccuuucagugagauuccaagacagggguuccuaggcgaaaucaggugcaauucugaguccagcgugcucucggcccaugaaucaugucugcgugcucccaaccuuauuucuuauaagccuaugaucgaccaauuggagugcaccacaaaucugauagauccauuugucguguucgaacggggaagucucccccagacccgaaacgacaaaacuuuugcagccuccaagggcaauagagggguucaggcuuucagcaaaggaucugugcaggccgaucugacauuaauguuugacaacuucgagguagauuuugucggcgcagcggugagcugugacgccgcuuuccugaaucuuacggguugcuacuccuguaacgccggggcaagggugugcuugucaaucaccaguacuggaacaggcagccucucugcucacaacaaggaugguucccugcauauuguccuaccgucagagaauggcaccaaggaccaaugccagauccugcacuuuacaguuccugaaguggaggaagaguucauguauaguugugacggggaugaacgcccacuccugguaaaaggaacucuuauugccaucgaccccuuugaugaccggagagaggcaggcggggagagcaccguggucaacccuaaguccggaucuuggaauuucuuugauugguucucgggcuugaugagcugguucggugggccccugaaaacgauauuacucauuugccuguacguggcccuuucaaucggacuguuuuucuugcucauuuaccugggcaggaccggucuauccaagauguggcuggcugcgaccaaaaaggccaguuga

SEQ ID NO: 17242 - RNA, 1668 nt, Artificial Sequence
  derived and/or modified CDS sequence (opt3) from RVFV(ZH-548)__DQ380206.1__IgE-leader_Gn(delSP)-variant1
auggacuggaccuggauccuguuccucguggccgcugcaacaagaguccacagcgaggauccccaucuuaggaaccggccuggcaaggggcacaauuacauugacggaaugacucaggaagaugccacgugcaaaccaguuaccuaugcgggugcuuguuccucuuuugacgugcuguuggagaagggcaaauucccguuauuucaaucauacgcccaucaccgcacacugcuagaagcaguacaugauacuauaaucgccaaggcugaucccccuaguugcgaccuccugagcgcacacgggaacccauguaugaaagagaaacuugugaugaagacccacugccccaaugacuaucaguccgcccauuaccugaacaaugauggaaaaauggcuucugucaaguguccuccaaaauaugaauugacagaggacugcaacuucugucgacagaugaccggcgccucgcucaagaaagguucauacccccugcaggaucuguuuugccaaagcagugaggacgauggguccaagcucaagacuaaaaugaagggagugugugaaguuggcgugcaggcguuaaagaagugcgacggccagcugucuacagcacacgaggucgugccuuucgccguauuuaaaaauagcaagaaaguuuaucuugacaaguuggaucugaagaccgaagagaaccuacucccagacuccuucguguguuuugagcauaaagggcaguacaagggaacgauggauucaggucaaacuaaacgugaacugaagaguuucgacauuagccagugcccgaaaaucggcgggcacggaucuaagaagugcaccggcgaugcugccuuuuguuccgcauacgagugcacagcucaguaugccaaugcguacuguucacacgccaacgguagcgggauuguccagauccaagugaguggaguguggaaaaagccccuuugcgucggcuaugaaagaguugugguaaaaagggagcugucugcaaagccuauacagcggguggaaccauguacuaccugcaucacaaaaugugagccccauggcuuggucgugcgcuccaccggguucaagauuagcucggcuguugccugcgcuucuggagugugugucacggguucccagucaccuaguacugagaucacacucaaguacccaggcauuagccaauccucugggggagacaucggcgugcacauggcccaugaugaccagagcguaucaaguaaaauaguugcacacugucccccgcaggauccuugccuggugcaugacugcauugucugcgcccacgguuuaaucaauuaucagugucacaccgcucuguccgcguuuguggucguguucguuuucagcucuauugcaaucaucugccucgccauucuuuacagagugcugaaguguuugaaaauagcucccaggaagguacuaaacccacugauguggaucacugccuuuauucgguggaucuauaaaaagauggucgcacgcguggccgauaauauaaaccaaguuaaucgagaaauuggguggauggagggcggacagcucgugcugggcaacccugcucccaucccaagacaugcccccaucccuagguacucaacauaccuuaugcuguugcucauugucaguuaugcaagcgcguga

SEQ ID NO: 17243 - RNA, 1662 nt, Artificial Sequence
  derived and/or modified CDS sequence (opt3) from RVFV(ZH-548)__DQ380206.1__IgE-leader_Gn(delSP)-variant2
auggacuggaccuggauccuguuccucguggccgcugcaacaagaguccacagcccccaucuuaggaaccggccuggcaaggggcacaauuacauugauggaaugacucaggaggacgccacgugcaaaccaguuaccuaugcgggugcuuguuccucuuuugaugugcuguuggaaaagggcaaauucccguuauuucaaucauacgcccaucaccgcacacugcuagaggcaguacaugacacuauaaucgccaaggcugaucccccuaguugcgaccuccugagcgcacacgggaacccauguaugaaagaaaaacuugugaugaagacccacugccccaaugauuaucaguccgcccauuaccugaacaaugacggaaaaauggcuucugucaaguguccuccaaaauaugaguugacagaagauugcaacuucugucgacagaugaccggcgccucgcucaagaaagguucauacccccugcaggaccuguuuugccaaagcagugaggaugacggguccaagcucaagacuaaaaugaagggagugugugagguuggcgugcaggcguuaaagaagugcgauggccagcugucuacagcacacgaagucgugccuuucgccguauuuaaaaauagcaagaaaguuuaucuugacaaguuggaccugaagaccgaggaaaaccuacucccagauuccuucguguguuuugagcauaaagggcaguacaagggaacgauggacucaggucaaacuaaacgugagcugaagaguuucgauauuagccagugcccgaaaaucggcgggcacggaucuaagaagugcaccggcgacgcugccuuuuguuccgcauacgaaugcacagcucaguaugccaaugcguacuguucacacgccaacgguagcgggauuguccagauccaagugaguggaguguggaaaaagccccuuugcgucggcuaugagagaguugugguaaaaagggaacugucugcaaagccuauacagcggguggagccauguacuaccugcaucacaaaaugugaaccccauggcuuggucgugcgcuccaccggguucaagauuagcucggcuguugccugcgcuucuggagugugugucacggguucccagucaccuaguacugagaucacacucaaguacccaggcauuagccaauccucugggggagauaucggcgugcacauggcccaugacgaucagagcguaucaaguaaaauaguugcacacugucccccgcaggacccuugccuggugcaugauugcauugucugcgcccacgguuuaaucaauuaucagugucacaccgcucuguccgcguuuguggucguguucguuuucagcucuauugcaaucaucugccucgccauucuuuacagagugcugaaguguuugaaaauagcucccaggaagguacuaaacccacugauguggaucacugccuuuauucgguggaucuauaaaaagauggucgcacgcguggccgacaauauaaaccaaguuaaucgagagauuggguggauggaaggcggacagcucgugcugggcaacccugcucccaucccaagacaugcccccaucccuagguacucaacauaccuuaugcuguugcucauugucaguuaugcaagcgcguga

SEQ ID NO: 17244 - RNA, 1578 nt, Artificial Sequence
  derived and/or modified CDS sequence (opt3) from RVFV(ZH-548)__DQ380206.1__IgE-leader_Gc
auggacuggaccuggauccuguuccucguggccgcugcaacaagaguccacagcugcuccgagcuuauucaggccucuucaaggauaacuacguguaguaccgaaggcguuaauacaaagugccggcugagcgggacugcguugauccgcgcuggauccgugggugccgaggcauguuuaaugcugaaaggcguaaaggaagaucaaaccaaauuucuaaagauuaaaacagugucuucggagcucucaugccgagaagggcagagcuacuggaccggaaguuucucccccaagugucugucuagccguagaugccaucuugucggcgagugucacgugaauaggugccuguccuggcgggacaacgagacuucagccgaauuuaguuucguuggugagagcacaaccaugcgcgaaaauaaguguuuugagcagugcgggggauggggcuguggcugcuucaacgugaauccuucuugcuuguuuguccauacguaucuccaguccgugagaaaagaggcucugaggguauucaacuguaucgauuggguucacaagcugacucucgaaauuaccgacuuugaugggucagugagcacaaucgacuuaggagcaaguucuucccgguucacuaauugggguagcgucucgcugucucuugaugccgagggcauauccgggucaaacaguuuuagcuucaucgaauccccaggaaaaggcuacgcuauuguggacgagccguuuucugaaaucccccgccaagguuucuugggggagauucgaugcaauagcgagucaagugugcuguccgcccaugaaagcugucuaagagcgccuaaccucaucucuuauaagccaaugauagaucagcuggagugcaccacaaaucuuauugaccccuucgucguuuuugaaaggggaucacugccucagacccggaacgauaaaacguucgcagccaguaagggcaaucguggcgugcaggcuuuuagcaagggguccguacaagccgacuugacucucauguucgauaacuuugagguggacuucgucggagcagcugugucuugugacgccgcguuucugaauuuaacagguugcuacucguguaacgccggcgcacgcguuugccugagcaucaccuccacugggacaggaucacucagugcucacaacaaagauggcucucuucacauugugcugccaagcgaaaaugguaccaaggaccagugucagaucuugcauuucacgguccccgagguggaggaagaguuuauguauuccugcgauggggacgaaagaccucuacugguaaaaggcacccucaucgccauugauccauucgacgauaggcgggaggcuggaggcgaaucaacaguugugaacccgaaaagcgggucuuggaacuuuuucgacugguuuuccggacugaugaguugguucgguggcccccuuaaaacuauacuguugaucugucucuacgucgcccugagcauuggguuauucuuucugcuaaucuaucucggacgaaccggccugucuaagauguggcuugcagccacaaagaaggcuuccuga

SEQ ID NO: 17245 - RNA, 738 nt, Artificial Sequence; identical to SEQ ID NO: 6907
  derived and/or modified CDS sequence (opt1) from RVFV(ZH-548)__DQ380151.1__N

SEQ ID NO: 17246 - RNA, 3594 nt, Artificial Sequence; identical to SEQ ID NO: 12733
  derived and/or modified CDS sequence (opt1) from RVFV(ZH-548)__DQ380206.1__GP

SEQ ID NO: 17247 - RNA, 3204 nt, Artificial Sequence
  derived and/or modified CDS sequence (opt1) from RVFV(ZH-548)__DQ380206.1__Gn-Gc
auggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcuga

SEQ ID NO: 17248 - RNA, 2955 nt, Artificial Sequence
  derived and/or modified CDS sequence (opt1) from RVFV(ZH-548)__DQ380206.1__Gne_SP-Gn_Gc
auggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggccauggcggggaucgccaugaccgugcugcccgcccuggccguguucgcgcucgcccccgucguguucgccgaggacugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcuga

SEQ ID NO: 17249 - RNA, 3189 nt, Artificial Sequence
  derived and/or modified CDS sequence (opt1) from RVFV(ZH-548)__DQ380206.1__IgE-leader_Gn(delSP)-Gc-variant1
auggacuggaccuggauccuguuccucguggccgccgcgacccgcguccacagcgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcuga

SEQ ID NO: 17250 - RNA, 3183 nt, Artificial Sequence
  derived and/or modified CDS sequence (opt1) from RVFV(ZH-548)__DQ380206.1__IgE-leader_Gn(delSP)-Gc-variant2
auggacuggaccuggauccuguuccucguggccgccgcgacccgcguccacagcccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcuga

SEQ ID NO: 17251 - RNA, 1668 nt, Artificial Sequence
  derived and/or modified CDS sequence (opt1) from RVFV(ZH-548)__DQ380206.1__IgE-leader_Gn(delSP)-variant1
auggacuggaccuggauccuguuccucguggccgccgcgacccgcguccacagcgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccuga

SEQ ID NO: 17252 - RNA, 1662 nt, Artificial Sequence
  derived and/or modified CDS sequence (opt1) from RVFV(ZH-548)__DQ380206.1__IgE-leader_Gn(delSP)-variant2
auggacuggaccuggauccuguuccucguggccgccgcgacccgcguccacagcccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccuga

SEQ ID NO: 17253 - RNA, 1578 nt, Artificial Sequence
  derived and/or modified CDS sequence (opt1) from RVFV(ZH-548)__DQ380206.1__IgE-leader_Gc
auggacuggaccuggauccuguuccucguggccgccgcgacccgcguccacagcugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcuga

SEQ ID NO: 17254 - RNA, 738 nt, Artificial Sequence; identical to SEQ ID NO: 6907
  derived and/or modified CDS sequence (opt1) from RVFV(ZH-548)__DQ380151.1__N

SEQ ID NO: 17255 - RNA, 3594 nt, Artificial Sequence; identical to SEQ ID NO: 12733
  derived and/or modified CDS sequence (opt1) from RVFV(ZH-548)__DQ380206.1__GP

SEQ ID NO: 17256 - RNA, 3204 nt, Artificial Sequence; identical to SEQ ID NO: 12883
  derived and/or modified CDS sequence (opt1) from RVFV(ZH-548)__DQ380206.1__Gn-Gc

SEQ ID NO: 17257 - RNA, 2955 nt, Artificial Sequence
  derived and/or modified CDS sequence (opt1) from RVFV(ZH-548)__DQ380206.1__Gne_SP-Gn_Gc
auggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcucagcgcccacggcaaccccugcaugaaggagaagcuggucaugaagacgcacugccccaacgacuaccaguccgcccacuaccugaacaacgacggcaagauggcgagcgugaagugcccgcccaaguacgagcucaccgaggacugcaacuucugccggcagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacgcugaaguacccggggaucagccaguccagcggcggggacaucggcguccacauggcccacgacgaccaguccgugagcuccaagaucguggcccacugcccgccccaggaccccugccugguccacgacugcaucgugugcgcccacggccucaucaacuaccagugccacaccgcgauggccgggaucgccaugaccgugcugcccgcccuggccgucuucgcgcucgcccccgugguguucgccgaggacugcagcgagcugauccaggccuccagccggaucaccacgugcuccaccgagggcgucaacaccaagugccgccugagcgggaccgcccucauccgggcgggcagcgugggggccgaggccugccugaugcugaagggcgugaaggaggaccagacgaaguuccucaagaucaagaccgucuccagcgagcuguccugccgcgagggccagagcuacuggaccggguccuucagccccaagugccuguccagccggcgcugccaccucgugggcgagugccacgugaaccggugccuguccuggcgcgacaacgagaccagcgccgaguucuccuucgucggggagagcacgaccaugcgggagaacaagugcuucgagcagugcggcggcugggggugcggcugcuucaacgugaaccccuccugccuguucgugcacaccuaccuccagagcguccgcaaggaggcccugcggguguucaacugcaucgacugggugcacaagcugacccucgagaucacggacuucgacggguccgucagcaccaucgaccugggcgcguccagcagccgcuucaccaacuggggguccgugagccugucccuggacgccgagggcaucagcggcuccaacagcuucuccuucaucgagagcccggggaagggcuacgccaucguggacgagcccuucuccgagaucccccggcagggguuccucggcgagauccgcugcaacagcgaguccagcguccuguccgcccacgagagcugccugcgcgcgccgaaccucaucuccuacaagcccaugaucgaccagcuggagugcaccaccaaccugaucgaccccuucgugguguucgagcgggggagccucccccagacgcgcaacgacaagaccuucgccgccuccaagggcaaccggggcguccaggccuucagcaagggguccgugcaggccgaccugacccugauguucgacaacuucgagguggacuucgucggcgcggccgugagcugcgacgccgccuuccucaaccugaccgggugcuacagcugcaacgccggcgcgcgcgugugccuguccaucacgagcaccgggaccggcucccucagcgcccacaacaaggacggcucccugcacaucguccugccgagcgagaacgggaccaaggaccagugccagauccuccacuucacggugcccgagguggaggaggaguucauguacuccugcgacggcgacgagcggccccugcuggucaaggggacccucaucgccaucgaccccuucgacgaccgccgggaggccggcggggagagcaccguggugaacccgaaguccggcagcuggaacuucuucgacugguucuccggccugaugagcugguucgggggcccccugaagaccauccuccugaucugccuguacgucgcccucuccaucgggcuguucuuccugcucaucuaccugggccgcacgggccugagcaagauguggcucgcggccaccaagaaggccuccuga

SEQ ID NO: 17258 - RNA, 3189 nt, Artificial Sequence
  derived and/or modified CDS sequence (opt1) from RVFV(ZH-548)__DQ380206.1__IgE-leader_Gn(delSP)-Gc-variant1
auggacuggaccuggauccuguuccucguggccgccgcgacccgcguccacagcgaggacccccaccuccggaaccgcccgggcaaggggcacaacuacaucgacggcaugacgcaggaggacgcgaccugcaagcccgugaccuacgccggggccugcuccagcuucgacgugcugcuggagaagggcaaguucccccuguuccaguccuacgcccaccaccggacccugcucgaggccguccacgacacgaucaucgccaaggccgacccgcccagcugcgaccugcuguccgcccacgggaaccccugcaugaaggagaagcucgugaugaagacccacugccccaacgacuaccagagcgcgcacuaccugaacaacgacggcaagauggccuccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagacgaagaugaagggggucugcgaggugggcgugcaggcccugaagaagugcgacgggcagcuguccaccgcccacgaggucgugcccuucgcgguguucaagaacagcaagaaggucuaccucgacaagcuggaccugaagaccgaggagaaccuccugcccgacuccuucgugugcuucgagcacaagggccaguacaagggcaccauggacagcgggcagacgaagcgggagcugaaguccuucgacaucagccagugcccgaagaucggcgggcacggcuccaagaagugcaccggcgacgccgccuucugcagcgccuacgagugcaccgcccaguacgcgaacgccuacugcagccacgccaacggguccggcaucgugcagauccaggucagcgggguguggaagaagccccucugcgugggcuacgagcgcgucguggugaagcgggagcuguccgccaagcccauccagcgcgucgagcccugcaccacgugcaucaccaagugcgagccgcacgggcugguggugcggagcaccggcuucaagaucuccagcgccgucgcgugcgccuccggcgugugcgucaccgggagccagucccccagcacggagaucacccucaaguaccccggcaucucccagagcuccgggggcgacaucggggugcacauggcccacgacgaccagagcguguccagcaagaucgucgcccacugcccgccccaggaccccugccuggugcacgacugcaucgugugcgcccacggccugaucaacuaccagugccacaccgcgcucuccgccuucgucgugguguucgucuucagcuccaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaacccggcccccaucccccggcacgcgcccaucccgcgcuacagcacguaccucaugcugcugcucaucgugagcuacgccuccgccugcagcgagcugauccaggccuccagccggaucacgaccugcuccaccgagggcgugaacaccaagugccgccugagcgggaccgcccucauccgggcgggcuccgucggcgccgaggccugccugaugcugaagggggugaaggaggaccagaccaaguuccucaagaucaagaccgugagcuccgagcugagcugccgcgagggccaguccuacuggacggggagcuucucccccaagugccugagcucccggcgcugccaccuggucggcgagugccacgugaaccgcugccucagcuggcgggacaacgagaccuccgccgaguucagcuucgugggcgagagcaccaccaugcgcgagaacaagugcuucgagcagugcgggggcugggggugcggcugcuucaacgucaaccccuccugccuguucgugcacacguaccugcagagcgugcggaaggaggcccuccgcgucuucaacugcaucgacugggugcacaagcugacccuggagaucaccgacuucgacggguccgugagcaccaucgaccucggcgcguccagcucccgguucaccaacuggggcagcgucucccugagccuggacgccgaggggaucuccggcagcaacuccuucagcuucaucgaguccccggggaagggcuacgccaucguggacgagcccuucagcgagaucccccgccagggguuccucggcgagauccggugcaacuccgagagcuccgugcugagcgcccacgagagcugccugcgcgcgcccaaccucaucuccuacaagccgaugaucgaccagcuggagugcacgaccaaccugaucgaccccuucgucguguucgagcggggcagccucccccagacccgcaacgacaagaccuucgccgccuccaaggggaaccggggcgugcaggccuucagcaagggguccguccaggccgaccugacgcugauguucgacaacuucgagguggacuucgugggcgcggccgucagcugcgacgccgccuuccucaaccugaccgggugcuacuccugcaacgccggcgcgcgcgugugccugagcaucaccuccaccggcacggggagccucuccgcccacaacaaggacggcagccugcacaucgugcugcccuccgagaacgggaccaaggaccagugccagauccuccacuucaccgucccggagguggaggaggaguucauguacagcugcgacggcgacgagcggccccugcuggugaaggggacccucaucgccaucgaccccuucgacgaccgccgggaggccggcggcgaguccacggucgugaaccccaagagcggguccuggaacuucuucgacugguucagcggccugauguccugguucgggggcccgcugaagaccauccuccugaucugccuguacguggcccucagcaucggccuguucuuccugcucaucuaccuggggcgcaccggccugagcaagauguggcucgcggccaccaagaaggccuccuga

SEQ ID NO: 17259 - RNA, 3183 nt, Artificial Sequence
  derived and/or modified CDS sequence (opt1) from RVFV(ZH-548)__DQ380206.1__IgE-leader_Gn(delSP)-Gc-variant2
auggacuggaccuggauccuguuccucguggccgccgcgacccgcguccacagcccccaccuccggaaccgcccgggcaaggggcacaacuacaucgacggcaugacgcaggaggacgcgaccugcaagcccgugaccuacgccggggccugcuccagcuucgacgugcugcuggagaagggcaaguucccccuguuccaguccuacgcccaccaccggacccugcucgaggccguccacgacacgaucaucgccaaggccgacccgcccagcugcgaccugcuguccgcccacgggaaccccugcaugaaggagaagcucgugaugaagacccacugccccaacgacuaccagagcgcgcacuaccugaacaacgacggcaagauggccuccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagacgaagaugaagggggucugcgaggugggcgugcaggcccugaagaagugcgacgggcagcuguccaccgcccacgaggucgugcccuucgcgguguucaagaacagcaagaaggucuaccucgacaagcuggaccugaagaccgaggagaaccuccugcccgacuccuucgugugcuucgagcacaagggccaguacaagggcaccauggacagcgggcagacgaagcgggagcugaaguccuucgacaucagccagugcccgaagaucggcgggcacggcuccaagaagugcaccggcgacgccgccuucugcagcgccuacgagugcaccgcccaguacgcgaacgccuacugcagccacgccaacggguccggcaucgugcagauccaggucagcgggguguggaagaagccccucugcgugggcuacgagcgcgucguggugaagcgggagcuguccgccaagcccauccagcgcgucgagcccugcaccacgugcaucaccaagugcgagccgcacgggcugguggugcggagcaccggcuucaagaucuccagcgccgucgcgugcgccuccggcgugugcgucaccgggagccagucccccagcacggagaucacccucaaguaccccggcaucucccagagcuccgggggcgacaucggggugcacauggcccacgacgaccagagcguguccagcaagaucgucgcccacugcccgccccaggaccccugccuggugcacgacugcaucgugugcgcccacggccugaucaacuaccagugccacaccgcgcucuccgccuucgucgugguguucgucuucagcuccaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaacccggcccccaucccccggcacgcgcccaucccgcgcuacagcacguaccucaugcugcugcucaucgugagcuacgccuccgccugcagcgagcugauccaggccuccagccggaucacgaccugcuccaccgagggcgugaacaccaagugccgccugagcgggaccgcccucauccgggcgggcuccgucggcgccgaggccugccugaugcugaagggggugaaggaggaccagaccaaguuccucaagaucaagaccgugagcuccgagcugagcugccgcgagggccaguccuacuggacggggagcuucucccccaagugccugagcucccggcgcugccaccuggucggcgagugccacgugaaccgcugccucagcuggcgggacaacgagaccuccgccgaguucagcuucgugggcgagagcaccaccaugcgcgagaacaagugcuucgagcagugcgggggcugggggugcggcugcuucaacgucaaccccuccugccuguucgugcacacguaccugcagagcgugcggaaggaggcccuccgcgucuucaacugcaucgacugggugcacaagcugacccuggagaucaccgacuucgacggguccgugagcaccaucgaccucggcgcguccagcucccgguucaccaacuggggcagcgucucccugagccuggacgccgaggggaucuccggcagcaacuccuucagcuucaucgaguccccggggaagggcuacgccaucguggacgagcccuucagcgagaucccccgccagggguuccucggcgagauccggugcaacuccgagagcuccgugcugagcgcccacgagagcugccugcgcgcgcccaaccucaucuccuacaagccgaugaucgaccagcuggagugcacgaccaaccugaucgaccccuucgucguguucgagcggggcagccucccccagacccgcaacgacaagaccuucgccgccuccaaggggaaccggggcgugcaggccuucagcaagggguccguccaggccgaccugacgcugauguucgacaacuucgagguggacuucgugggcgcggccgucagcugcgacgccgccuuccucaaccugaccgggugcuacuccugcaacgccggcgcgcgcgugugccugagcaucaccuccaccggcacggggagccucuccgcccacaacaaggacggcagccugcacaucgugcugcccuccgagaacgggaccaaggaccagugccagauccuccacuucaccgucccggagguggaggaggaguucauguacagcugcgacggcgacgagcggccccugcuggugaaggggacccucaucgccaucgaccccuucgacgaccgccgggaggccggcggcgaguccacggucgugaaccccaagagcggguccuggaacuucuucgacugguucagcggccugauguccugguucgggggcccgcugaagaccauccuccugaucugccuguacguggcccucagcaucggccuguucuuccugcucaucuaccuggggcgcaccggccugagcaagauguggcucgcggccaccaagaaggccuccuga

SEQ ID NO: 17260 - RNA, 1668 nt, Artificial Sequence
  derived and/or modified CDS sequence (opt1) from RVFV(ZH-548)__DQ380206.1__IgE-leader_Gn(delSP)-variant1
auggacuggaccuggauccuguuccucguggccgccgcgacccgcguccacagcgaggacccccaccuccggaaccgcccgggcaaggggcacaacuacaucgacggcaugacgcaggaggacgcgaccugcaagcccgugaccuacgccggggccugcuccagcuucgacgugcugcuggagaagggcaaguucccccuguuccaguccuacgcccaccaccggacccugcucgaggccguccacgacacgaucaucgccaaggccgacccgcccagcugcgaccugcuguccgcccacgggaaccccugcaugaaggagaagcucgugaugaagacccacugccccaacgacuaccagagcgcgcacuaccugaacaacgacggcaagauggccuccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagacgaagaugaagggggucugcgaggugggcgugcaggcccugaagaagugcgacgggcagcuguccaccgcccacgaggucgugcccuucgcgguguucaagaacagcaagaaggucuaccucgacaagcuggaccugaagaccgaggagaaccuccugcccgacuccuucgugugcuucgagcacaagggccaguacaagggcaccauggacagcgggcagacgaagcgggagcugaaguccuucgacaucagccagugcccgaagaucggcgggcacggcuccaagaagugcaccggcgacgccgccuucugcagcgccuacgagugcaccgcccaguacgcgaacgccuacugcagccacgccaacggguccggcaucgugcagauccaggucagcgggguguggaagaagccccucugcgugggcuacgagcgcgucguggugaagcgggagcuguccgccaagcccauccagcgcgucgagcccugcaccacgugcaucaccaagugcgagccgcacgggcugguggugcggagcaccggcuucaagaucuccagcgccgucgcgugcgccuccggcgugugcgucaccgggagccagucccccagcacggagaucacccucaaguaccccggcaucucccagagcuccgggggcgacaucggggugcacauggcccacgacgaccagagcguguccagcaagaucgucgcccacugcccgccccaggaccccugccuggugcacgacugcaucgugugcgcccacggccugaucaacuaccagugccacaccgcgcucuccgccuucgucgugguguucgucuucagcuccaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaacccggcccccaucccccggcacgcgcccaucccgcgcuacagcacguaccucaugcugcugcucaucgugagcuacgccuccgccuga

SEQ ID NO: 17261 - RNA, 1662 nt, Artificial Sequence
  derived and/or modified CDS sequence (opt1) from RVFV(ZH-548)__DQ380206.1__IgE-leader_Gn(delSP)-variant2
auggacuggaccuggauccuguuccucguggccgccgcgacccgcguccacagcccccaccuccggaaccgcccgggcaaggggcacaacuacaucgacggcaugacgcaggaggacgcgaccugcaagcccgugaccuacgccggggccugcuccagcuucgacgugcugcuggagaagggcaaguucccccuguuccaguccuacgcccaccaccggacccugcucgaggccguccacgacacgaucaucgccaaggccgacccgcccagcugcgaccugcuguccgcccacgggaaccccugcaugaaggagaagcucgugaugaagacccacugccccaacgacuaccagagcgcgcacuaccugaacaacgacggcaagauggccuccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagacgaagaugaagggggucugcgaggugggcgugcaggcccugaagaagugcgacgggcagcuguccaccgcccacgaggucgugcccuucgcgguguucaagaacagcaagaaggucuaccucgacaagcuggaccugaagaccgaggagaaccuccugcccgacuccuucgugugcuucgagcacaagggccaguacaagggcaccauggacagcgggcagacgaagcgggagcugaaguccuucgacaucagccagugcccgaagaucggcgggcacggcuccaagaagugcaccggcgacgccgccuucugcagcgccuacgagugcaccgcccaguacgcgaacgccuacugcagccacgccaacggguccggcaucgugcagauccaggucagcgggguguggaagaagccccucugcgugggcuacgagcgcgucguggugaagcgggagcuguccgccaagcccauccagcgcgucgagcccugcaccacgugcaucaccaagugcgagccgcacgggcugguggugcggagcaccggcuucaagaucuccagcgccgucgcgugcgccuccggcgugugcgucaccgggagccagucccccagcacggagaucacccucaaguaccccggcaucucccagagcuccgggggcgacaucggggugcacauggcccacgacgaccagagcguguccagcaagaucgucgcccacugcccgccccaggaccccugccuggugcacgacugcaucgugugcgcccacggccugaucaacuaccagugccacaccgcgcucuccgccuucgucgugguguucgucuucagcuccaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaacccggcccccaucccccggcacgcgcccaucccgcgcuacagcacguaccucaugcugcugcucaucgugagcuacgccuccgccuga

SEQ ID NO: 17262 - RNA, 1578 nt, Artificial Sequence
  derived and/or modified CDS sequence (opt1) from RVFV(ZH-548)__DQ380206.1__IgE-leader_Gc
auggacuggaccuggauccuguuccucguggccgccgcgacccgcguccacagcugcuccgagcugauccaggccagcucccggaucacgaccugcagcaccgagggcgugaacaccaagugccgccuguccgggacggcccucauccgggccggcagcgugggggccgaggcgugccugaugcugaagggcgucaaggaggaccagaccaaguuccucaagaucaagaccguguccagcgagcuguccugccgcgaggggcagagcuacuggaccggcuccuucagccccaagugccuguccagccggcgcugccaccucgugggcgagugccacgucaaccggugccuguccuggcgcgacaacgagacgagcgccgaguucuccuucgugggggagagcaccaccaugcgggagaacaagugcuucgagcagugcggcggguggggcugcgggugcuucaacgugaacccguccugccuguucguccacaccuaccuccagagcgugcgcaaggaggcccugcggguguucaacugcaucgacuggguccacaagcugacgcucgagaucaccgacuucgacggcagcguguccaccaucgaccugggcgccagcuccagccgcuucaccaacuggggguccgugagccugucccucgacgcggagggcaucagcggguccaacagcuucuccuucaucgagagccccggcaagggcuacgccaucgucgacgagcccuucuccgagaucccccggcagggguuccugggcgagauccgcugcaacagcgaguccagcgugcuguccgcccacgagagcugccuccgggccccgaaccugaucuccuacaagcccaugaucgaccagcuggagugcacgaccaaccucaucgaccccuucguggucuucgagcgcgggagccugccccagacccggaacgacaagaccuucgccgcgagcaagggcaaccgcggggugcaggccuucuccaagggcagcgugcaggccgaccugacgcucauguucgacaacuucgaggucgacuucgugggcgccgccguguccugcgacgcggccuuccugaaccugaccgggugcuacagcugcaacgccggcgcccgggucugccucuccaucaccagcaccgggacgggcucccugagcgcccacaacaaggacgggucccugcacaucgugcucccgagcgagaacggcaccaaggaccagugccagauccugcacuucaccguccccgagguggaggaggaguucauguacuccugcgacggcgacgagcgcccccugcucgugaaggggacccugaucgcgaucgaccccuucgacgaccggcgcgaggccggcggggagagcacggucgugaacccgaaguccggcagcuggaacuucuucgacugguucuccgggcugaugagcugguucggcggcccccucaagaccauccugcugaucugccucuacguggcccuguccaucgggcuguucuuccuccugaucuaccugggccgcaccgggcucagcaagauguggcuggccgccaccaagaaggcgagcuga

SEQ ID NO: 17263 - RNA, 738 nt, Artificial Sequence; identical to SEQ ID NO: 7599
  derived and/or modified CDS sequence (opt5) from RVFV(ZH-548)__DQ380151.1__N

SEQ ID NO: 17264 - RNA, 3594 nt, Artificial Sequence; identical to SEQ ID NO: 14376
  derived and/or modified CDS sequence (opt5) from RVFV(ZH-548)__DQ380206.1__GP

SEQ ID NO: 17265 - RNA, 3204 nt, Artificial Sequence; identical to SEQ ID NO: 14526
  derived and/or modified CDS sequence (opt5) from RVFV(ZH-548)__DQ380206.1__Gn-Gc

SEQ ID NO: 17266 - RNA, 2955 nt, Artificial Sequence
  derived and/or modified CDS sequence (opt5) from RVFV(ZH-548)__DQ380206.1__Gne_SP-Gn_Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccuguccgcccauggcaacccuuguaugaaagagaagcugguuaugaagacacacugcccgaaugauuaucagucugcucacuaccucaacaaugacgggaaaauggccagcgugaagugucccccuaaauaugaacugaccgaggauugcaacuuuuguagacagaugacaggagcgucccuuaagaaaggcucuuacccccugcaggaccucuucugccaaagcuccgaggaugacggcagcaagcugaagaccaaaaugaagggggucugugaagugggaguucaggcccuuaaaaagugcgauggccagcugucuacggcucaugagguggucccuuuugccguguucaaaaauuccaagaaaguguaucucgacaagcuggaccugaagaccgaagagaaccuccugcccgauagcuuugucuguuucgagcacaaagggcaguacaagggaacaauggacucuggccaaaccaaacgggaacuuaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucagauccaagugucuggcguguggaaaaagccucugugcgucggguaugaacgcgugguugugaaaagagagcucagcgccaagcccauucagcgggucgaaccuuguacgacaugcaucaccaaaugugagccccacggacuggugguucgcuccacaggcuuuaagauuagcucugccguggcuugcgccuccggggucugugugaccggaagccagucucccagcaccgagaucacacuuaaguacccuggcauuucccaaucuagcggcggggauaucggaguccauauggcgcacgacgaucaguccgugagcucuaaaauuguugcucauugcccgccccaggacccuugucuggugcacgauugcaucgucugcgcccauggccucaucaauuaucagugucacacggccauggcugggauugccaugaccgugcugcccgcucuggccguuuucgcgcucgccccuguggucuucgcugaagacugcuccgagcugauccaagccagcucuagaauuacaaccuguuccacagaaggagugaacaccaagugccggcuuagcggcacggcucugauccgcgccggguccgugggcgcggaggccugucucaugcugaaaggaguuaaggaagaucagacaaaauuucuuaagauuaagaccgucucuagcgagcuguccugcagagagggccagucuuacuggaccgggagcuucucccccaaaugucucagcucucggcgcugccaccuggugggagaaugucaugugaauagaugccuguccuggcgggacaacgagacaagcgcugaauuuucuuucgucggcgaguccaccacaaugcgcgaaaauaaguguuuugagcagugcgggggauggggcugcggguguuucaacgugaacccgagcugccucuuuguucacacguaucugcaaucugugagaaaagaggcccuucgggucuucaauuguaucgacugggugcauaagcugacccucgaaaucacagauuuugacggcagcguuuccaccauugaucugggagcuucuagcuccagauucacaaacuggggcagcgugucccugucucuugacgccgaggggaucagcggauccaauucuuuuagcuucauugaauccccuggcaaaggguacgccaucgucgaugagcccuuuucugagauuccucgccagggauuccucggcgaaauccggugcaacagcgaguccagcgugcugucugcucacgaauccugucugagagcgcccaaucucaucagcuacaagccuaugauugaccagcuggagugcaccacgaaccuuaucgaucccuucguuguguuugaacgcgggucucugccgcagacccggaaugacaaaacauucgccgcuuccaagggcaacagaggaguccaagccuuuagcaagggcucugugcaggccgaucucacccugauguucgacaauuuugagguggauuucgucggggcugccguuuccugugacgcggcuuuucugaaccuuacaggaugcuauagcuguaaugccggcgcccgcgugugccucuccauuaccagcacggggacaggaucucugagcgcucacaacaaagauggcucccugcauaucgugcucccuucugagaaugggaccaaggaccagugucagauucugcacuucacaguccccgaaguggaggaagaguuuauguacagcugcgacggcgaugaacggccccuucugguuaaaggaacccucaucgccauugacccuuucgaugacagacgcgaggcgggcggggaguccaccguggucaacccgaagucuggaagcuggaacuuuuucgauugguuuuccggccugaugucuugguucgggggaccccugaaaacaauccuucucaucugccuguauguggcucugagcauuggccucuucuuucugcuuaucuaccugggccggacggggcucuccaagauguggcuggccgccaccaagaaagcuagcuga

SEQ ID NO: 17267 - RNA, 3189 nt, Artificial Sequence
  derived and/or modified CDS sequence (opt5) from RVFV(ZH-548)__DQ380206.1__IgE-leader_Gn(delSP)-Gc-variant1
auggacuggaccuggauccuguuccucguggccgcugccacaagaguccacagcgaggauccccaucugcggaaccgcccuggcaaggggcacaauuacauugacggaaugacgcaggaagaugcgaccugcaaaccgguuacauaugcuggcgccuguuccucuuuugacgugcuucuggagaaggggaaauucccccucuuucaaagcuacgcccaucacagaacccugcuugaagcugugcaugauacaaucauugccaaggcugacccucccuccugcgaucugcucucugcccacggaaacccuuguaugaaagagaagcuggucaugaagacccacugccccaaugacuaucagagcgcgcauuaccugaacaaugauggcaaaauggccuccgugaaguguccuccgaaauaugaacucacagaggacugcaacuucugucggcagaugaccggggcuucucugaagaaaggaagcuacccccuucaggaucuguuuugccaauccagcgaggacgauggcucuaagcucaagacgaaaaugaagggcguuugugaaguggggguccaggcccugaaaaagugcgacggacagcuuuccaccgcucacgaggugguuccuuucgccguguuuaaaaauagcaagaaagucuaucuggacaagcucgaucugaagacagaagagaaccugcuccccgacucuuucguguguuuugagcauaaaggccaguacaaggggaccauggauuccggacaaacaaaacgcgaacuuaagagcuucgacaucucucagugcccuaaaauuggcgggcacggauccaagaagugcaccggcgaugcggccuuuuguagcgcuuacgagugcacggcccaguaugcuaaugccuacuguucccacgccaacggcucugggaucgugcagauccaagucagcggaguuuggaaaaagccccugugcgugggcuaugaaagaguggucgugaaacgggagcuguccgcuaagccgauucagcgcguugaaccuuguacaaccugcaucacaaaaugugagccccaugggcucguggucagaagcaccggauucaagauuucuuccgcgguggccugcgcuagcggcguuugugugaccgggucucagagcccuuccacagagaucacgcugaaguaccccggaauuucucaaagcuccggcggcgacaucgggguccacauggcccaugaugaccagagcgugucuuccaaaauugucgcccacugucccccucaggauccgugccuugugcaugacugcaucguuugcgcucacggacugaucaauuaucagugucacaccgcccucagcgcguuuguggucguguucguuuucucuuccauugcuaucauuugccuggccauccuguaccgggugcucaagugucugaaaauugcuccccgcaagguccuuaacccucugauguggaucacagccuuuaucagauggauuuauaaaaagaugguggcccggguggcugauaauaucaaccaaguuaaucgcgaaauuggcuggauggaagggggacagcucguccugggcaaccccgccccuauccccagacaugcgccgauuccucgguacagcaccuaccuuaugcugcuccugaucguguccuaugccucugcuugcagcgaacugauccaggccuccucucgcauuacaaccuguagcacggagggggugaacacaaagugcagacucuccggcaccgcucugauccgggccggaagcgucggcgcggaagccugucuuaugcugaaaggggugaaggaggaccagaccaaauuccucaagauuaaaacaguuucuuccgagcugagcugcagagaaggacaaucuuacuggaccggcuccuuuagccccaagugucugucuagccgccggugccaccuugugggggagugucaugucaauagaugccucuccuggcgcgacaacgaaacaagcgcugaguucucuuuugugggagaauccacgaccaugcgggagaauaaaugcuucgagcaguguggcggguggggcugcggauguuuuaacguuaauccuagcugccuguucgugcacacauaucugcaguccgucagaaaggaagcccuccgcguguuuaacuguaucgauuggguucacaagcugacccuugagauuacagacuucgauggcucugugagcaccaucgaccugggggcuuccucuagccgguuuacgaauuggggauccgucucucucagccuggaugccgaaggcauuuccgggagcaacucuuucuccuuuaucgagagccccggaaaaggcuacgccaucguggacgagccuuucucugaaauucccagacagggguuccugggcgagauccgcugcaauuccgaaagcucugugcuuuccgcucaugagagcugucuccgggcgccgaaccugauuuccuauaagccuaugaucgaucaacuggaaugcaccacaaaucucauugaccccuuugucguuuucgagagaggaagccugccccagacccgcaacgauaaaacauuugccgcuucuaagggcaauagaggggugcaggccuucagcaaaggauccgugcaggccgaccuuacccugauguuugauaacuucgaggucgacuuugugggcgcugccguuucuugugaugcggcuuuccucaaucugacggggugcuacagcuguaacgccggagcccgggugugccuguccaucacaucuaccggcacagggagccuuuccgcucacaacaaggacggcucucuccauaucguccugccuagcgaaaauggaaccaaggaccaaugccagauucugcacuuuaccgugccggagguugaagaggaguucauguauuccugugauggcgacgagcggccccuccuggugaaagggacacuuaucgccauugauccuuuugacgaucgcagagaggcgggaggcgaaagcacggucgugaaccccaagucuggguccuggaauuucuuugacugguucagcggacugaugucuugguucggcggcccucucaaaaccauccugcugauuugccuuuacguugcucucuccaucgggcuguuuuuccugcucaucuaccugggacggacaggccuuagcaagauguggcuggccgccaccaaaaaggcuuccuga

SEQ ID NO: 17268 - RNA, 3183 nt, Artificial Sequence
  derived and/or modified CDS sequence (opt5) from RVFV(ZH-548)__DQ380206.1__IgE-leader_Gn(delSP)-Gc-variant2
auggacuggaccuggauccuguuccucguggccgcugccacaagaguccacagcccccaucugcggaaccgcccuggcaaggggcacaauuacauugauggaaugacgcaggaggacgcgaccugcaaaccgguuacauaugcuggcgccuguuccucuuuugaugugcuucuggaaaaggggaaauucccccucuuucaaagcuacgcccaucacagaacccugcuugaggcugugcaugacacaaucauugccaaggcugauccucccuccugcgaccugcucucugcccacggaaacccuuguaugaaagaaaagcuggucaugaagacccacugccccaaugauuaucagagcgcgcauuaccugaacaaugacggcaaaauggccuccgugaaguguccuccgaaauaugagcucacagaagauugcaacuucugucggcagaugaccggggcuucucugaagaaaggaagcuacccccuucaggaccuguuuugccaauccagcgaggaugacggcucuaagcucaagacgaaaaugaagggcguuugugagguggggguccaggcccugaaaaagugcgauggacagcuuuccaccgcucacgaagugguuccuuucgccguguuuaaaaauagcaagaaagucuaucuggacaagcucgaccugaagacagaggaaaaccugcuccccgauucuuucguguguuuugagcauaaaggccaguacaaggggaccauggacuccggacaaacaaaacgcgagcuuaagagcuucgauaucucucagugcccuaaaauuggcgggcacggauccaagaagugcaccggcgacgcggccuuuuguagcgcuuacgaaugcacggcccaguaugcuaaugccuacuguucccacgccaacggcucugggaucgugcagauccaagucagcggaguuuggaaaaagccccugugcgugggcuaugagagaguggucgugaaacgggaacuguccgcuaagccgauucagcgcguugagccuuguacaaccugcaucacaaaaugugaaccccaugggcucguggucagaagcaccggauucaagauuucuuccgcgguggccugcgcuagcggcguuugugugaccgggucucagagcccuuccacagagaucacgcugaaguaccccggaauuucucaaagcuccggcggcgauaucgggguccacauggcccaugacgaucagagcgugucuuccaaaauugucgcccacugucccccucaggacccgugccuugugcaugauugcaucguuugcgcucacggacugaucaauuaucagugucacaccgcccucagcgcguuuguggucguguucguuuucucuuccauugcuaucauuugccuggccauccuguaccgggugcucaagugucugaaaauugcuccccgcaagguccuuaacccucugauguggaucacagccuuuaucagauggauuuauaaaaagaugguggcccggguggcugacaauaucaaccaaguuaaucgcgagauuggcuggauggaagggggacagcucguccugggcaaccccgccccuauccccagacaugcgccgauuccucgguacagcaccuaccuuaugcugcuccugaucguguccuaugccucugcuugcagcgagcugauccaggccuccucucgcauuacaaccuguagcacggaaggggugaacacaaagugcagacucuccggcaccgcucugauccgggccggaagcgucggcgcggaggccugucuuaugcugaaaggggugaaggaagaucagaccaaauuccucaagauuaaaacaguuucuuccgagcugagcugcagagagggacaaucuuacuggaccggcuccuuuagccccaagugucugucuagccgccggugccaccuugugggggaaugucaugucaauagaugccucuccuggcgcgacaacgagacaagcgcugaguucucuuuugugggagaauccacgaccaugcgggaaaauaaaugcuucgagcaguguggcggguggggcugcggauguuuuaacguuaauccuagcugccuguucgugcacacauaucugcaguccgucagaaaggaggcccuccgcguguuuaacuguaucgacuggguucacaagcugacccuugaaauuacagauuucgacggcucugugagcaccaucgaucugggggcuuccucuagccgguuuacgaauuggggauccgucucucucagccuggacgccgagggcauuuccgggagcaacucuuucuccuuuaucgaaagccccggaaaaggcuacgccaucguggaugagccuuucucugagauucccagacagggguuccugggcgaaauccgcugcaauuccgagagcucugugcuuuccgcucaugaaagcugucuccgggcgccgaaccugauuuccuauaagccuaugaucgaccaacuggagugcaccacaaaucucauugaucccuuugucguuuucgaaagaggaagccugccccagacccgcaacgacaaaacauuugccgcuucuaagggcaauagaggggugcaggccuucagcaaaggauccgugcaggccgaucuuacccugauguuugacaacuucgaggucgauuuugugggcgcugccguuucuugugacgcggcuuuccucaaucugacggggugcuacagcuguaacgccggagcccgggugugccuguccaucacaucuaccggcacagggagccuuuccgcucacaacaaggauggcucucuccauaucguccugccuagcgagaauggaaccaaggaccaaugccagauucugcacuuuaccgugccggaaguugaggaagaguucauguauuccugugacggcgaugaacggccccuccuggugaaagggacacuuaucgccauugacccuuuugaugaccgcagagaggcgggaggcgagagcacggucgugaaccccaagucuggguccuggaauuucuuugauugguucagcggacugaugucuugguucggcggcccucucaaaaccauccugcugauuugccuuuacguugcucucuccaucgggcuguuuuuccugcucaucuaccugggacggacaggccuuagcaagauguggcuggccgccaccaaaaaggcuuccuga

SEQ ID NO: 17269 - RNA, 1668 nt, Artificial Sequence
  derived and/or modified CDS sequence (opt5) from RVFV(ZH-548)__DQ380206.1__IgE-leader_Gn(delSP)-variant1
auggacuggaccuggauccuguuccucguggccgcugccacaagaguccacagcgaggauccccaucugcggaaccgcccuggcaaggggcacaauuacauugacggaaugacgcaggaggaugcgaccugcaaaccgguuacauaugcuggcgccuguuccucuuuugacgugcuucuggagaaggggaaauucccccucuuucaaagcuacgcccaucacagaacccugcuugaagcugugcaugauacaaucauugccaaggcugacccucccuccugcgaucugcucucugcccacggaaacccuuguaugaaagagaagcuggucaugaagacccacugccccaaugacuaucagagcgcgcauuaccugaacaaugauggcaaaauggccuccgugaaguguccuccgaaauaugaacucacagaggacugcaacuucugucggcagaugaccggggcuucucugaagaaaggaagcuacccccuucaggaucuguuuugccaauccagcgaggacgauggcucuaagcucaagacgaaaaugaagggcguuugugaaguggggguccaggcccugaaaaagugcgacggacagcuuuccaccgcucacgaggugguuccuuucgccguguuuaaaaauagcaagaaagucuaucuggacaagcucgaucugaagacagaagagaaccugcuccccgacucuuucguguguuuugagcauaaaggccaguacaaggggaccauggauuccggacaaacaaaacgcgaacuuaagagcuucgacaucucucagugcccuaaaauuggcgggcacggauccaagaagugcaccggcgaugcggccuuuuguagcgcuuacgagugcacggcccaguaugcuaaugccuacuguucccacgccaacggcucugggaucgugcagauccaagucagcggaguuuggaaaaagccccugugcgugggcuaugaaagaguggucgugaaacgggagcuguccgcuaagccgauucagcgcguugaaccuuguacaaccugcaucacaaaaugugagccccaugggcucguggucagaagcaccggauucaagauuucuuccgcgguggccugcgcuagcggcguuugugugaccgggucucagagcccuuccacagagaucacgcugaaguaccccggaauuucucaaagcuccggcggcgacaucgggguccacauggcccaugaugaccagagcgugucuuccaaaauugucgcccacugucccccucaggauccgugccuugugcaugacugcaucguuugcgcucacggacugaucaauuaucagugucacaccgcccucagcgcguuuguggucguguucguuuucucuuccauugcuaucauuugccuggccauccuguaccgggugcucaagugucugaaaauugcuccccgcaagguccuuaacccucugauguggaucacagccuuuaucagauggauuuauaaaaagaugguggcccggguggcugauaauaucaaccaaguuaaucgcgaaauuggcuggauggaagggggacagcucguccugggcaaccccgccccuauccccagacaugcgccgauuccucgguacagcaccuaccuuaugcugcuccugaucguguccuaugccucugcuuga

SEQ ID NO: 17270 - RNA, 1662 nt, Artificial Sequence
  derived and/or modified CDS sequence (opt5) from RVFV(ZH-548)__DQ380206.1__IgE-leader_Gn(delSP)-variant2
auggacuggaccuggauccuguuccucguggccgcugccacaagaguccacagcccccaucugcggaaccgcccuggcaaggggcacaauuacauugauggaaugacgcaggaggacgcgaccugcaaaccgguuacauaugcuggcgccuguuccucuuuugaugugcuucuggaaaaggggaaauucccccucuuucaaagcuacgcccaucacagaacccugcuugaggcugugcaugacacaaucauugccaaggcugauccucccuccugcgaccugcucucugcccacggaaacccuuguaugaaagaaaagcuggucaugaagacccacugccccaaugauuaucagagcgcgcauuaccugaacaaugacggcaaaauggccuccgugaaguguccuccgaaauaugagcucacagaagauugcaacuucugucggcagaugaccggggcuucucugaagaaaggaagcuacccccuucaggaccuguuuugccaauccagcgaggaugacggcucuaagcucaagacgaaaaugaagggcguuugugagguggggguccaggcccugaaaaagugcgauggacagcuuuccaccgcucacgaagugguuccuuucgccguguuuaaaaauagcaagaaagucuaucuggacaagcucgaccugaagacagaggaaaaccugcuccccgauucuuucguguguuuugagcauaaaggccaguacaaggggaccauggacuccggacaaacaaaacgcgagcuuaagagcuucgauaucucucagugcccuaaaauuggcgggcacggauccaagaagugcaccggcgacgcggccuuuuguagcgcuuacgaaugcacggcccaguaugcuaaugccuacuguucccacgccaacggcucugggaucgugcagauccaagucagcggaguuuggaaaaagccccugugcgugggcuaugagagaguggucgugaaacgggaacuguccgcuaagccgauucagcgcguugagccuuguacaaccugcaucacaaaaugugaaccccaugggcucguggucagaagcaccggauucaagauuucuuccgcgguggccugcgcuagcggcguuugugugaccgggucucagagcccuuccacagagaucacgcugaaguaccccggaauuucucaaagcuccggcggcgauaucgggguccacauggcccaugacgaucagagcgugucuuccaaaauugucgcccacugucccccucaggacccgugccuugugcaugauugcaucguuugcgcucacggacugaucaauuaucagugucacaccgcccucagcgcguuuguggucguguucguuuucucuuccauugcuaucauuugccuggccauccuguaccgggugcucaagugucugaaaauugcuccccgcaagguccuuaacccucugauguggaucacagccuuuaucagauggauuuauaaaaagaugguggcccggguggcugacaauaucaaccaaguuaaucgcgagauuggcuggauggaagggggacagcucguccugggcaaccccgccccuauccccagacaugcgccgauuccucgguacagcaccuaccuuaugcugcuccugaucguguccuaugccucugcuuga

SEQ ID NO: 17271 - RNA, 1578 nt, Artificial Sequence
  derived and/or modified CDS sequence (opt5) from RVFV(ZH-548)__DQ380206.1__IgE-leader_Gc
auggacuggacauggauccuguuccucguggccgcugccacaagaguccacagcugcuccgagcugauucaggcgucuagccggaucacgaccuguuccacagaaggcguuaauaccaagugccgccuuucugggacagcucugauuagagccggaagcgugggcgccgaggcuugucucaugcugaaaggggugaaggaagaucaaaccaaauuucuuaagaucaaaacagucuccucugagcugagcugccgggaaggacaguccuacuggaccggcagcuucucucccaagugucucuccagccgcagaugccaucuggugggggagugucacguuaaucggugccugucuuggcgcgacaacgagacguccgccgaauuuagcuucgugggagagucuaccacaaugagagaaaauaaguguuuugagcagugcggcggcuggggguguggaugcuucaacgucaauccuuccugccucuuugugcauaccuaucugcagagcguucggaaagaggcucuccgcguguucaacuguauugauuggguccacaagcugacacucgaaaucaccgacuuugauggcuccgugucuacgaucgaccugggggccagcuccagcagauucacaaauuggggaucugugucccuuagccuggaugcggagggcauuucugggagcaacuccuuuucuuucaucgaaagcccgggaaaaggcuacgccauugucgacgagcccuuuuccgaaaucccucggcaaggcuuccucggggagauucgcugcaauagcgagucuuccguucugagcgcucaugaaucuugucugagagcccccaaccucaucuccuauaagccuaugauugaucagcuggagugcaccacaaaucuuaucgaccccuucgugguguuugaacggggaagccugccucagacccgcaacgauaaaaccuucgcugccuccaagggcaauagagggguccaggcguuuucuaagggaagcgugcaagccgaccucacacugauguucgauaacuuugagguugacuucgugggcgcugccgucuccugugacgcugccuuucuuaaucugacggggugcuacucuuguaacgccggagcucgggugugccucagcaucaccuccacaggcaccggcagccugucugcgcacaacaaagaugggucccugcacauuguucucccgagcgaaaauggaacaaaggaccagugucagauccugcauuucaccgugcccgaggucgaggaagaguuuauguauucuugcgauggcgacgaaagaccucuucuggugaaagggacgcucauugccaucgaucccuucgacgaucgccgggaggcuggaggcgaauccacagucgugaacccuaagagcgggucuuggaacuuuuucgacugguuuagcggccugauguccugguucggaggcccccuuaaaaccauucugcucaucugucuguacguugcccugagcaucgggcuuuucuuucugcuuauuuaucugggaagaaccggccucucuaagauguggcuggccgcuaccaaaaaggccuccuga

SEQ ID NO: 17272 - RNA, 738 nt, Artificial Sequence
  derived and/or modified CDS sequence (opt11) from RVFV(ZH-548)__DQ380151.1__N
auggacaacuaccaagaacucgcaauccaguucgccgcccaagccgucgaccgcaacgaaaucgaacaauggguccgagaauuugccuaccaaggcuucgacgcccgacgagucaucgaacuccucaaacaauacggaggcgccgacugggaaaaagacgccaagaaaaugaucguacuagcccucacccgaggcaacaaaccccgccgaaugaugaugaaaaugucaaaagaaggcaaagccaccgucgaagcccucaucaacaaauacaaacucaaggaaggcaaccccucccgggacgaacucacacucucccgcguagccgcagcccucgccggcuggaccugccaagcccucgucguccuauccgaauggcuuccagucacaggcacaaccauggacggccucucccccgccuauccccgccacaugaugcaccccucauucgccggcauggucgaccccucacuccccggcgacuaccuacgagccauccuagacgcacacucccucuaccuccuccaauucucccgcgucaucaaccccaaccuacgcggccgcaccaaagaagaaguagccgccaccuucacacaaccaaugaacgccgcagucaacuccaacuucaucucccacgaaaaacgccgcgaauuucucaaagccuucggccuuguagacuccaacggcaaacccuccgccgccgucauggcugccgcacaagcguacaaaaccgccgcauaa

SEQ ID NO: 17273 - RNA, 3594 nt, Artificial Sequence
  derived and/or modified CDS sequence (opt11) from RVFV(ZH-548)__DQ380206.1__GP
auguacguucugcucaccauacucaucuccguccucgucugugaagcaguuauucgggucucacuaucgagcacucgggaagagacaugcuucggagacuccaccaauccagaaaugauagagggugccugggacucauuacgagaggaagaaaugccagaggaacucucgugcucaauaucgggcauucgggaggucaaaacguccagucaagagcuauaucgcgcacugaaagcaaucauugcagccgacggacucaauaacaucacgugccauggaaaagacccagaggacaaaauaucacuaaucaagggcccaccacacaagaaacgagucggcauaguccgaugcgaacgucgccgcgacgccaaacaaaucggucgagaaaccauggccggaaucgcaaugaccguacuacccgcccucgcgguuuucgcccuagcacccgucgucuucgcggaagacccccaccuccgcaaccggccaggcaaaggucacaacuauauagacggaaugacgcaggaagacgcaacauguaaaccaguaaccuaugccggcgcaugcagcucauuugacguccuccucgagaaaggcaaguucccgcuauuccaaagcuacgcucaccaccgcacccuccuggaggccguacacgacacaauaaucgcgaaagcggacccacccaguugcgaucuacuaucggcccacggaaaucccuguaugaaagaaaagcuaguuaugaaaacccauugccccaacgacuaccagagcgcccacuaccucaacaaugaugggaaaauggccucagucaaaugcccgcccaaauacgaacuaaccgaggacugcaacuucugccgccaaaugaccggagccucacuaaagaaaggcucuuacccccuccaagaccucuuuugccaaucguccgaggacgauggcucaaaacuuaaaacaaaaaugaaaggugucugcgaagucggagugcaagcccugaagaaaugugacggacaacucuccacagcccacgaaguaguacccuucgccguauucaaaaacucaaagaaaguauaccuggacaaacuggaccuuaaaacagaggaaaaccugcugcccgacuccuuugugugcuucgaacacaaaggccaauacaaaggcacuauggacagcggacagaccaaacgggaacuaaagagcuucgacaucucccaaugucccaaaauuggcggccacggauccaagaaauguacaggggacgccgccuucugcucagccuacgaaugcaccgcgcaauacgcuaacgcguacugcucccaugccaacggguccggcaucguccagauccaagucuccggcguguggaagaaaccucucuguguaggcuaugaacgcgucguagucaaaagagaacucucugcuaaacccauccaacggguggaaccaugcaccacgugcauaacaaaaugcgagccacacggccucguuguucgauccacaggcuuuaaaaucucaagcgcuguagccugcgcauccggcgucugcgucaccgguucucaguccccaucaacagagaucacacugaaauaccccggcauaucccaaucaucgggcggcgacauaggaguucacauggcucacgacgaccagagcguauccuccaaaaucgucgcccacugcccaccccaggaccccugccucguucaugacugcaucgucugugcacacggccucauaaacuaccaaugccacaccgcccuauccgccuuugucgugguauucguauucagcagcaucgcaaucauaugccuugcaauccuguaccgcguccugaaaugccuuaaaauugccccacgcaaaguccucaacccacugauguggaucacugccuucauacgcuggauauacaagaaaauggucgcccgcguagccgacaacaucaaccaaguaaaccgagagauaggcuggauggagggcggccaacucguccuuggcaacccagccccaauacccaggcacgcaccgauuccucgguauuccacauaccucaugcuccuucugaucgucagcuacgcaucggccugcuccgaacucauacaggcauccagcagaauuacaaccuguucaaccgagggcgucaacacgaaaugucgucuguccgguaccgcacuaauacgcgcugguucaguaggagcggaggccugucuuaugcuuaaaggcguaaaagaggaucaaaccaaauuccugaaaaucaaaacagugagcucggaacucucaugccgcgaaggacaauccuacuggacaggaucguucucaccaaaaugccuaucuagcagacgaugccaccucgucggggagugccaugugaaucgcugccucuccuggcgagacaacgagacaagcgccgaguucucuuucguaggggaaagcaccaccaugagagaaaacaaaugcuucgaacagugcggcggauggggaugcggcugcuuuaacgucaaccccucgugccuguuuguacauacuuaccuccaaucaguacgcaaagaagcauugcgcguuuucaauugcaucgacuggguccacaaacucacccuagaaaucacagacuucgacggcuccgucucgaccaucgaccugggcgccagcuccucaagguucacgaacuggggcuccguaucccucucccuugacgcggaaggaaucuccggcagcaacucguucucauucaucgaaucacccggaaaaggcuacgccaucgucgacgaacccuucuccgaaauaccgagacaaggauuccucggagaaaucagaugcaacucagagagcuccgugcugucugcccacgaaaguugccucagagcacccaaccucaucagcuacaaaccaaugaucgaucaacuagaaugcacuacuaaccuaauagaccccuuugucguuuucgaacgcggcucccucccacaaaccaggaacgacaaaaccuuugcagcuaguaaaggaaacagaggaguccaagcguucucaaaaggcucaguccaagcagaucuaacccucauguucgacaacuucgagguugacuucgugggcgccgcagucuccugugacgcagcguucuugaaccucacaggcugcuacucuugcaacgccggagcaagaguuugccucucaaucacgagcacaggaacgggaucccuaucagcccacaacaaagacggcagccuucacaucguacucccgucugagaacggaaccaaagaucaaugucaaauccuacacuucaccguacccgaagucgaagaagaguucauguacucuugcgacggcgacgaacgaccacuacucgucaaagggacccucaucgcaauugacccauucgaugaucgccgcgaagcuggaggcgagagcacagucgucaaccccaaaagcggcuccuggaacuuuuucgacugguucagcggacucauguccugguuugguggcccacucaaaacaauccuccucaucugccucuacguagcccugagcaucggccucuucuuccuccuuaucuaccuagggcgaacagggcuuucgaaaauguggcuugcugccaccaagaaagccuccuag

SEQ ID NO: 17274 - RNA, 3204 nt, Artificial Sequence
  derived and/or modified CDS sequence (opt11) from RVFV(ZH-548)__DQ380206.1__Gn-Gc
auggcaggaauagcaaugacgguucugccagcgcuagccguuuucgcacuagcaccagucgucuucgcggaagacccccaucuacgcaaccgacccggaaaaggacacaacuacaucgacggaaugacacaagaagaugcaacaugcaaaccagucacauacgcaggcgccugcuccuccuucgacguccuacuugagaaagguaaauucccccucuuucaaagcuacgcgcaccaccguacccuccucgaagcaguccacgacacaaucauagcaaaggcugacccacccagcugugaccuccucuccgcccauggcaaccccugcaugaaggaaaaacucguaaugaaaacacacugcccgaacgacuaccaauccgcccacuaccucaacaacgacggaaagauggccucuguuaagugcccaccaaaauacgagcugaccgaagacugcaacuuuugccgucaaaugaccggagccucccucaagaaagggucauacccacuccaagaucuauuuugccaaagcuccgaggacgacggcagcaaauuaaaaaccaagaugaaagguguaugcgaagugggcguccaggcccucaagaaaugcgacggccaacuuuccacugcacacgaagugguacccuucgccguguucaaaaacuccaagaaagucuauuuagacaaacucgaccuaaaaacggaagagaaccuccuacccgacucauuugucugcuuugagcacaaaggccaauacaaaggaacaauggauagcgggcaaacaaaaagggaacucaaguccuucgacaucagccagugccccaaaaucggcggacaugggagcaaaaagugcaccggcgacgcugcauucugcagugccuacgagugcaccgcgcaauacgcuaacgcauacugcagucaugcuaacggcagcggaauuguacaaauccaggucuccggcguguggaagaaaccacuaugcguaggcuacgaacggguugucgucaaaagagagcuuuccgccaaacccauucaacgaguugaaccaugcacuacauguaucaccaaaugugaaccucauggucuaguuguccgcucgaccggauucaagaucucgagcgccguagccugcgccuccggagugugcgucacaggcucacaaucccccucgacagaaauuacccugaaauacccuggaaucucccaguccucgggaggcgacauagggguacacauggcccacgacgaccaaagcgucuccuccaaaauaguagcucacugcccaccacaggaccccugucucguacacgacugcauaguaugugcacauggucucaucaacuaccaaugccacacagcacucagugcauuuguaguuguauucguauucuccucuaucgccaucaucugccuagccauacucuacaggguccucaaaugccuaaaaaucgcaccacgaaaaguccucaacccccuaauguggauaaccgccuucauccgcuggauauacaagaaaauggucgcccgcgucgcagacaacaucaaucaagucaaccgugaaaucggcuggauggaaggaggacaacugguccuuggaaacccagcgccaauaccccgccacgccccaauuccucgauacuccaccuaccuaaugcuucuccuaaucguauccuacgccuccgccugcagcgaacucauacaggcuuccucacgcauaacuacgugcuccaccgaaggaguuaacaccaaaugccgacucucagggacagcccuaaucagagcgggaaguguaggcgcagaagccugccuuaugcugaaaggagucaaagaggaccaaacaaaauuccuaaagaucaaaaccgucucaucugagcucagcugccgcgaaggacaauccuacuggacagguuccuucucccccaaaugccugucaucccgcagaugccauuuagucggcgagugccauguaaaccgaugccucuccuggcgcgacaacgagacuucagcggaguucagcuucguaggggaaucuacaaccaugcgugagaacaagugcuucgaacaaugcggaggcuggggaugcgguugcuucaacgucaacccauccugccuauucguacauacuuaccuccaguccgucagaaaagaggcgcuacgcgucuucaacuguauagacuggguucacaaacuuacccuggaaauaaccgacuucgacggauccgucagcacaauagaucugggagcuuccagcucacguuucacgaacuggggguccgucucgcuuucucuagacgccgaaggcauaagcggcuccaacuccuucuccuucaucgaaagccccggcaaaggcuacgccaucguagacgagccauucucagagaucccccgccaaggcuuccucggcgagaucagauguaacagcgaauccuccguacucucagcacacgaauccugccuucgcgcaccaaaucuuaucuccuacaaacccaugaucgaccaacuagaauguaccaccaaucuaauagaucccuucguaguauucgaacgcggcucucuaccccaaacacgcaacgacaaaacauucgcggccuccaaagggaaccggggcgugcaagccuucuccaaaggaaguguccaagccgaucucacacucauguucgacaacuuugaaguagacuucgucggggcggccguaaguugcgaugcggccuuccuaaaccugaccggcuguuacucaugcaacgcgggcgccagagucugccucuccauaaccuccaccggaaccggaucacugucagcacacaacaaagacggaucccuacacaucguccuuccauccgaaaauggcacaaaagaccaaugccaaaucuuacacuucaccgucccagaaguagaagaagaguucauguacaguugcgacggagaugagcgcccguuacucguaaagggcacacuuauagccauugacccguucgacgacagacgugaggccggaggagaaagcaccgucguaaauccaaagucagggucauggaacuucuucgacugguuuuccggauuaauguccugguucggaggcccucucaaaacuauacuccuaauaugccuauacgucgcccucuccaucggccuauucuuccuccuaauauaccucggacgcacaggccucuccaaaauguggcuagccgccaccaaaaaggccuccuaa

SEQ ID NO: 17275 - RNA, 2955 nt, Artificial Sequence
  derived and/or modified CDS sequence (opt11) from RVFV(ZH-548)__DQ380206.1__Gne_SP-Gn_Gc
auggcaggaaucgccaugacaguccuaccagcacuugccguauuugcccucgccccaguaguauuugccgaagacccacaccucagaaaccgacccggaaaaggacacaacuauaucgauggcaugacccaggaagaugcaacaugcaaaccuguaaccuacgccggcgcaugcuccagcuucgacguacuacuugagaaaggcaaauuuccacucuuucaaucuuacgcucaccaccgcacccuucuagaggccguccacgacacgaucauagcuaaagccgacccaccaagcugcgaccuccucucagcccauggcaacccaugcaugaaagagaaacucguaaugaaaacccacugccccaacgacuaccaguccgcucacuaccucaauaacgacggaaaaauggccucagucaaaugcccacccaaauacgagcuuacagaggacugcaacuucugccgccaaaugaccggagccucacucaagaaaggaagcuacccccuucaggaccuauucugccagagcucagaagacgacgguagcaagcuaaaaaccaaaaugaaagggguuugcgaggucggcguccaggcgcucaagaaaugcgacggucaacucucuacagcacaugaagucguacccuucgccguuuucaaaaacagcaagaaagucuaccucgacaaacuagaccucaaaaccgaagaaaaccuacuccccgacagcuucgugugcuucgaacacaaaggccaauauaaaggcacgauggacuccggacagaccaaaagggaacuaaaauccuucgacauaucccaaugccccaaaaucggaggccacggauccaagaaaugcaccggagacgccgccuucugcucagcauacgaaugcacagcacaauacgccaacgcauacugcagccacgcaaacggauccggaauagugcagauccaaguaagcggagucuggaagaaaccccucugugucggcuacgaacgcguggucguaaaaagagagcuuucagcuaaaccaauacaacgaguagaacccugcaccacgugcauuacaaaaugcgaaccacacggccucgucguucgcagcacugguuucaaaauaucuagcgcgguagcaugcgccucaggcguaugcgugaccggaucccagucaccaucaacagaaaucacccucaaauacccgggcauuucacaaucaucagguggcgacaucgggguacacauggcacacgacgaucaauccgucucuucaaaaaucgucgcccacugcccaccccaggaccccuguuuagugcacgacuguauagucugcgcccacggccuaauuaacuaccaaugccacaccgccauggccggaaucgcaaugacagucuuaccggcccucgcaguauucgcccuagccccaguugucuucgcagaagacugcucagaacuaauccaagccucuucccgaaucaccacaugcagcaccgaaggcgucaacacaaaaugccgccucucgggcaccgcccucauacgcgcaggcagcgucggcgccgaagcgugccuaaugcuuaaaggagucaaagaagaucaaaccaaauuucuaaaaaucaaaacugugagcucagaacucucaugcagagaaggacaaagcuacuggaccggaucauuuucuccuaaaugccugagcucucgcagaugccaccucguaggagagugccaugucaaccgcugucucucuuggcgagacaacgagaccuccgcagaguucagcuucguaggugaaucaacaaccaugcgagaaaacaaaugcuucgaacaaugcgguggcugggguugcggaugcuucaacgucaaccccucaugucucuucguccacacauaccuccaaagcguucgcaaagaagcucuacgcguauucaauugcauugauuggguacauaagcucacacuagaaaucacggacuuugacggcucagucucaaccaucgaucucggugcauccaguucgcgcuucacuaacuggggaagcgucucgcuuucccucgaugccgaaggcauauccggaucgaacucauucucguucauugaaucacccggcaaaggcuacgccaucguagaugaacccuucagugaaaucccgagacaaggauuccuaggagaaauccggugcaacuccgaaucgagcguccucuccgcacacgaauccugccuccgcgccccuaaucucaucuccuacaaaccaaugaucgaucaacucgaauguacaacaaaccugaucgaucccuucgucguguuugaacguggcucacucccccaaacccgcaaugacaaaacguucgccgcuucuaaaggcaaccggggcguccaggcuuucagcaagggcuccguccaagccgaccucacgcucauguucgacaacuucgaagucgacuucgucggagccgcuguuuccugugacgccgcauuucuaaacuuaaccgggugcuacagcugcaaugccggcgcaagaguaugccucuccaucaccucaaccggaacuggcucccuaagcgcccacaacaaagacggcucacuccacaucguccuaccaagcgaaaacggcacgaaagaccaaugccaaauccugcacuuuaccguacccgaagucgaagaggaguucauguauagcugcgacggcgacgaacgaccacuucuagucaaaggcacacucaucgccaucgaccccuucgacgaccgcagagaagcaggcggugaaucaacugugguaaaccccaaaucaggcagcuggaacuucuucgacugguucuccggacucaugagcugguucggcggcccccuuaagaccaucuuacucaucugccuauacgucgcacuauccaucggacucuucuuucuacucaucuaccucggccgcacaggccucucuaaaauguggcuagccgcaaccaagaaagcaaguuaa

SEQ ID NO: 17276 - RNA, 3189 nt, Artificial Sequence
  derived and/or modified CDS sequence (opt11) from RVFV(ZH-548)__DQ380206.1__IgE-leader_Gn(delSP)-Gc-variant1
auggacuggaccuggauacuguuccucguagccgccgcuacccgcguccauagugaagacccacaccuaagaaaccgccccggaaaagggcacaacuacauagaugguaugacacaagaggacgcgacguguaaacccguaaccuaugcuggagcuuguagcuccuuugauguccuucucgagaaaggaaaauucccccucuuccaauccuacgcccaccacagaacccuacucgaggcagugcaugacacaauaaucgcuaaagcagacccaccaucuugcgaucuauuaucugcucacggaaaccccugcaugaaagaaaagcuagucaugaaaacccacugccccaacgauuaccaaucagcacauuaccuuaauaacgacggcaaaauggccuccgucaaaugucccccaaaauacgaacucacagaggauugcaacuucugccgccagaugaccggcgccucccucaagaaaggguccuacccucuccaagaccuauucugccaauccuccgaagacgacggcuccaaauuaaaaacgaaaaugaaaggcgucugcgaagugggcguucaagcucucaagaaaugcgacggucaacuauccaccgcacacgaagucguucccuucgcagucuucaaaaauucuaagaaagucuaccuagacaaacuugaccuaaaaaccgaagagaaucuccuacccgacuccuucgucugcuucgaacacaaaggacaauacaaaggcaccauggauuccggccaaacaaaacgcgaacucaaauccuucgacaucucacaaugucccaaaauaggaggucacggaucgaagaaaugcaccggagacgcugccuucugcucugcauacgaaugcaccgcccaauaugccaacgccuacuguucacacgccaacggcuccggcauaguccaaauacaagucucgggcguauggaagaaaccccucugcguaggcuacgagcgagugguagucaaaagagaacucuccgccaaaccgauccaacgcgucgagccaugcacaacguguauuacaaaaugcgaaccacacgggcuaguuguccggucgaccggguucaaaaucucuucagccguagccugcgccucagguguaugcgucaccggaucacaauccccgagcaccgaaauaacccuaaaauacccggggaucagccagucguccggcggcgauaucggcguucacauggcgcacgacgaccagagcgucagcagcaaaaucgucgcccacuguccuccccaagaccccugccugguacacgacugcaucgucugcgcucacggccucauaaacuaccagugccauaccgcccuguccgccuucguugucguauucgucuucuccucaaucgccaucaucugccuagccauacuauaccgcguacucaaaugucuaaaaaucgcaccccgcaaaguacuuaacccucuaauguggaucaccgcauucauccgcuggaucuauaagaaaaugguagcccgggucgccgacaacaucaaccaagucaaccgugaaaucggauggauggaaggcggacaacucguccugggcaaccccgccccaaucccgcgacacgccccaaucccucgcuacuccaccuaccucaugcuacuacucaucguaagcuacgcuuccgcaugcuccgagcuaauccaggcuuccucccgcaucacaacuuguucaacagagggcguaaacacaaaauguagacugucuggcacagcccuaauacgugcaggaagcguaggagccgaagccugccucaugcuuaaaggaguaaaagaagaccaaacgaaauuucucaaaaucaaaacagucaguuccgagcucucaugccgcgaaggccaauccuacuggaccggcaguuucucccccaaaugccuaagcagucgccgcugccaccucgucggcgaaugccacguaaaucgauguuugucauggcgagauaaugaaaccuccgcagaguuuucauuuguaggcgaauccaccaccaugcgcgaaaacaaaugcuucgaacaaugcggagguuggggcugcggcugcuucaacgugaacccgucaugccucuucguucacaccuaucuucaauccgugcgcaaagaagcacuccgcguguuuaauugcaucgacuggguccacaaacuuacccuugaaauaacugacuucgacggcuccgucuccacaauagacuuaggagccucaucaucaagauucaccaauuggggaucaguuucccucucgcucgacgcugaagguauaaguggcaguaacucauucucauucaucgaaucacccggcaaaggcuaugcuaucguagaugagcccuuuuccgagaucccacgacaaggauuucuaggggaaauucgcuguaauucggaguccuccguccuaucggcccacgaaucaugccuccgcgccccaaaccucaucucguacaaacccaugaucgaccaguuggaaugcaccacaaaccucauugaccccuucguggucuucgaacgaggaagccucccccaaacacgcaacgacaaaaccuucgccgccucgaagggcaaccgcggcguacaagccuucaguaaaggaucgguccaagcagaccuuacccucauguucgacaacuucgaggucgacuucguuggagcggcgguguccugcgaugccgcauuccucaaccucacaggcugcuacuccugcaacgcuggagcacgcguaugcuuaucaauaaccucuacuggaacuggcucacuauccgcccacaacaaggacggcagccuccacaucguccucccaucagaaaacggcacaaaagaucagugccaaauacuccacuuuacggucccggaggucgaagaagaguucauguacagcugcgacggcgacgaacgcccccuccuaguaaaagguacccugauagcaaucgaccccuucgaugaccgccgagaggccggcggggaauccacaguggucaacccgaaauccggcagcuggaacuucuucgacugguucuccgggcuuauguccugguucggcggcccucucaaaacgauacuacuaaucugccuauacgucgcgcuguccauaggcuuauucuuccuacuaauauaccuugggcgcacuggccucucaaagauguggcuggccgccaccaagaaggccuccuaa

SEQ ID NO: 17277 - RNA, 3183 nt, Artificial Sequence
  derived and/or modified CDS sequence (opt11) from RVFV(ZH-548)__DQ380206.1__IgE-leader_Gn(delSP)-Gc-variant2
auggauuggacguggauccuguuucucguggccgccgcgaccagaguccacagcccacaucucagaaaccgcccgggcaagggacacaacuacauagacggcaugacccaggaggacgcgaccugcaagcccgugaccuacgccggcgccuguagcagcuucgacguacugcuggagaagggcaaauucccccuguuccaguccuacgcacaccaccggacacugcucgaggcgguccaugacacaaucauagcuaaggccgacccucccucgugcgaccuucuauccgcgcacgggaaucccugcaugaaggagaagcucgucaugaagacccacugucccaacgacuaccagagcgcccacuaccugaacaacgacggcaaaauggccucugugaagugcccucccaaauacgagcucacagaggauugcaacuucugcaggcagaugacuggcgccucguuaaagaaagggucuuacccucugcaggaccuguucugccagagcuccgaagacgacggaagcaagcucaagacgaagaugaagggcgucugcgaggugggcgugcaggcccugaagaaaugcgacgggcagcuguccacugcccacgaggucguaccauucgcgguguucaaaaacagcaagaaagucuacuuggacaagcuggaucuuaagaccgaggagaaccuacuccccgacucuuuugugugcuucgagcauaaggggcaguauaagggcacgauggacaguggacagacaaagcgagagcugaaaaguuucgacauuagccagugcccgaaaaucggcggucacggcuccaagaagugcaccggcgacgccgccuucugcuccgccuacgaguguacugcccaguacgcgaacgccuacugcagccacgcaaaugggaguggcauagugcagauccaggucagcgggguauggaagaagccacuaugcgugggcuacgagcgcgugguggugaagcgggaacuguccgcuaagcccauccagcgcgucgagcccugcaccacuugcaucaccaagugcgagccccacgggcuggugguccggagcaccgguuucaaaauuuccagcgccgucgcgugcgcguccggugugugcgucaccgggagccagucccccagcacggagaucacccucaaguaccccggcaucucccagagcuccgggggcgacaucggggugcacauggcccacgacgaccaaucuguguccucaaagaucguggcccacugcccuccccaggaccccugccuggugcacgacugcaucgugugcgcccacggccugauaaacuaccagugccacacggcgcucagcgcguuuguuguaguguucgucuucagcuccaucgccaucaucugccuagccauucuguaccgggugcucaagugccugaagaucgcuccccggaaagugcugaauccucugauguggaucaccgccuucauccgguggaucuacaagaagaugguggcccggguugccgacaacaucaaccaagugaaccgcgagaucggcuggauggagggcgggcagcugguccuggggaacccggcccccaucccccgacacgcgcccaucccccgcuacucuacguaccucaugcugcugcucaucgugucguacgccucugcaugcagcgaguugauccaggcguccagcaggaucacaaccugcagcaccgagggcgucaacacgaagugccgccugaguggaaccgcccucauccgggcgggcuccguuggcgcugaggccugccugauguuaaaggggguaaaggaagaccaaaccaaauucuugaagaucaagaccgucagcuccgaacugagcugccgagaaggccaguccuacuggacggggucuuucagucccaagugccugagcucccgacgcugccaucucgucggugagugccacgucaaccgcugccucucauggcgggacaacgagacauccgccgaguucucauuugugggcgaguccaccaccaugcgcgagaacaagugcuuugagcagugcgguggcuggggcugcggaugcuucaacgucaaccccuccugccuguucguccauacguaccugcagagcgugcggaaggaggcccucagggucuucaacugcaucgacugggugcacaagcugacccuggagaucaccgacuucgacggcucuguguccaccauugacuugggcgcguccagcagcagauuuacgaacuggggcagcgucagucucagccuggacgccgaggggaucuccggcaguaacuccuucucguucaucgaguccccggggaagggcuacgccaucguagacgagcccuucucagagaucccccgccagggguuucucggcgagauucgcugcaacuccgaaagcucaguuuugagcgcccacgaaagcugucugcgcgcgccuaaccucaucuccuacaagcccaugaucgaccagcuggagugcacgaccaaccugaucgaccccuucguggucuucgagcggggcagccucccccagacccgcaacgacaagaccuucgccgccucaaaagggaacaggggcgugcaagccuucucaaagggguccguacaagccgaccuuacgcugauguucgacaacuuugagguugacuucgugggcgcggccguuagcugcgacgccgcguuucucaaccugaccggauguuacaguugcaaugcgggggcacgcgucugccuuucuaucaccagcaccggcacggggagccucuccgcccacaacaaggacggcucgcuacacaucguauuaccgagcgagaacgggaccaaggaccagugccagauucuccacuucaccguaccggagguggaggaggaguucauguacuccugcgacggugacgaacggccccuacugguaaaagggacccuaaucgccaucgaccccuucgacgaccgccgcgaggcgggcggcgaguccacggucgugaaccccaaaagcggguccuggaacuucuucgacugguucagcggccugaugagcugguucgggggcccguuaaagacuauccuccuuauuugccuguauguggcgcucagcaucggccuguucuuuuuauuaauauaccuggggcgcaccggccugagcaagauguggcucgcggcuacaaagaaggccuccuga

SEQ ID NO: 17278 - RNA, 1668 nt, Artificial Sequence
  derived and/or modified CDS sequence (opt11) from RVFV(ZH-548)__DQ380206.1__IgE-leader_Gn(delSP)-variant1
auggacuggaccuggauccucuuccuagucgccgcagccacccgcguccacuccgaagacccacaccuacggaaccgcccaggaaaaggacacaacuacauugacggcaugacccaagaggacgcaaccugcaaaccaguaacauacgccggcgccugcuccuccuucgacguccuccuagaaaaaggcaaauucccacuauuccaauccuacgcccaccaccgaacacugcucgaagccguacacgacaccaucauagcaaaagccgacccaccuuccugcgaccuccucuccgcccacggcaaccccugcaugaaggaaaaacucgucaugaagacccacugccccaacgacuaccagagcgcccacuaccucaacaacgacggcaagauggcuagcgucaagugucccccaaaauacgaacucacugaagacugcaacuucugccgccaaaugacaggggcaucucucaagaaaggcuccuacccacuccaagaccuguucugccaaucaagcgaagacgacggauccaaacucaaaaccaaaaugaaaggagucugcgaaguuggcguccaagcccucaagaaaugcgauggccaacuaucaacagcucacgaagucguccccuucgccgucuucaaaaacucuaagaaagucuaccucgacaaacucgaccucaaaaccgaagaaaaccuacuccccgauucauucgucugcuucgaacacaaaggccaguacaaaggaaccauggacucaggccaaacaaaacgcgaacuaaaaucauucgacaucucacaaugcccaaaaaucgguggacacggcucaaagaaaugcaccggagaugcggccuucugcagcgccuacgaaugcaccgcucaauaugcaaacgccuacugcucccacgccaacggcucaggaaucguccagauccaaguauccggagucuggaagaaaccccuaugcgucggcuacgaacgcguaguaguaaaacgagaacucuccgccaaaccuauacaacgcguagaacccugcacaacaugcauaacaaaaugcgagccccacggccuagucguccgcuccaccggauucaaaauuuccucugcagucgcaugcgccucaggagucugcgucacaggcucacaaucgcccucaaccgaaaucacucucaaauacccaggcaucagccaaagcuccggcggagacaucggaguccacauggcccacgacgaccaauccgucuccagcaaaauaguggcacacugcccuccacaggaucccugccucguucacgacugcaucgucugcgcccacggccucauaaacuaccaaugccacaccgcccucuccgcguucgucgucguuuucguauucucguccaucgcaaucaucugccuugcaauccucuaccggguccucaaaugucuaaaaaucgcaccccgaaaaguccucaacccucuaauguggauaacagccuucauaagauggaucuacaagaaaauggucgcccgcguagccgacaacaucaaccaggucaaccgagaaaucggcuggauggaaggaggccaacucguccucggcaacccagccccuaucccacgacacgcacccaucccccgcuacuccaccuaccucaugcuccuacucauaguauccuacgccuccgccuag

SEQ ID NO: 17279 - RNA, 1662 nt, Artificial Sequence
  derived and/or modified CDS sequence (opt11) from RVFV(ZH-548)__DQ380206.1__IgE-leader_Gn(delSP)-variant2
auggacuggaccuggauccucuuccucgucgcugcagcaacacgcguccacucgccacaccuucgcaacagaccaggcaaaggccacaacuacauagacggaaugacacaagaagacgcaaccugcaaacccgucacauacgccggcgcaugcucauccuucgacguccuacuagaaaagggcaaauucccccuauuccaauccuacgcccaccaccgaacccuccuagaagccguccacgacaccaucauagcaaaggccgauccucccuccugcgaccugcugucagcacacggcaaucccugcaugaaagaaaagcuagucaugaaaacacacugccccaacgacuaccaaagcgcccacuaucucaacaacgacggcaaaauggcaucagucaaaugcccacccaaauacgaacugaccgaagacuguaacuucugccgccaaaugaccggcgccucucucaagaaaggaucauacccccuccaagaccuauucugccaauccagugaagacgacggauccaaacucaaaaccaaaaugaaaggcgucugcgaaguuggagugcaggcccucaagaaaugcgacggccaacuuuccaccgcccaugagguaguacccuucgccguauucaaaaacucgaagaaaguauaccuagacaaacucgacuuaaaaaccgaagaaaaccuccuccccgacucauucgucugcuucgaacacaaaggccaauacaaaggcaccauggacuccggacaaaccaaacgcgaacucaaauccuucgacaucagccaaugucccaaaauaggaggacacggcagcaagaaaugcaccggcgacgccgcauuuugcucagccuacgaaugcacagcacaauacgcaaacgcauacugcucacacgcaaacggcuccggaaucguccaaauccaaguauccgguguuuggaagaaaccccucugcgucggauacgaacgcgucguugucaaaagagaacucucagccaaaccaauccaacgcgucgaacccugcacaaccugcaucaccaaaugcgaaccucacgggcuagucguccgauccaccgguuucaaaaucucaagcgccgucgccugugccagcgguguaugcguaaccggaucccaaucuccaucaaccgaaaucacucuaaaauaccccggaauaagccaguccuccggaggagacauaggcguccacauggcacacgacgaccaaucagucucauccaaaauaguagcacacugcccgccacaagacccaugccuaguccacgauugcaucgucugcgcccacggccuaaucaacuaucaaugccacaccgcacucagcgcauucguggucgucuucgucuucuccagcaucgcaaucauaugccucgccauccucuaccgcguacucaaaugccuaaaaauagccccucgaaaaguucucaacccccucauguggaucaccgcuuuuauccgauggaucuacaagaaaaugguagcucgagucgccgauaacaucaaccaaguaaaccgcgaaaucggauggauggaaggcggccaacucguccuaggaaauccggcccccauaccuagacacgcacccaucccucgcuacucaaccuaccuuaugcuacuccuuauaguaucuuacgcauccgcuuga

SEQ ID NO: 17280 - RNA, 1578 nt, Artificial Sequence
  derived and/or modified CDS sequence (opt11) from RVFV(ZH-548)__DQ380206.1__IgE-leader_Gc
auggacuggacauggauccucuuccucguggccgcagccacaagaguccacucgugcuccgaacuuauccaagccuccagccgaaucacaaccugcagcaccgaaggcguaaauaccaaaugccgacucuccggcaccgcccuaauccgcgcaggcucaguaggcgccgaagccugccuuaugcucaaaggagucaaagaagaccaaaccaaauuccucaaaaucaagaccguaagcagcgaacuaagcugccgagaaggccagagcuauuggacaggcucauucucacccaaaugccucaguucccgcagaugccaccuagucggcgaaugccacgucaaccggugccucucauggcgggacaacgaaaccagcgcggaauuuagcuucguaggagaaucaacuaccaugcgagaaaauaagugcuucgagcaaugcggcggcuggggaugcggcugcuucaacguaaaccccucaugccuauucguccacacauaccuccaauccguccgcaaggaagcccuacgcgucuuuaacugcauugacugggugcacaaacuuacacucgaaaucacggacuucgacggcagcgucagcacaauagaccucggcgccuccagcucccgcuucaccaauuggggcuccguaagccucucccuggacgcagaaggcaucucaggcuccaauucguucuccuucauagaaucaccugggaaaggcuacgccaucguagacgaacccuucagcgaaauuccacgccaaggcuuccuaggagaaauccgcugcaacucugaaucaagcguacucuccgcccacgaauccugucuacgcgcccccaaucuaaucagcuacaaacccaugauugaccaacucgaaugcacaaccaauuuaaucgacccauuugucgucuucgagcgcggaucacuaccacaaacccgaaacgacaaaaccuucgcagcaagcaagggaaaccgcgguguacaagccuucagcaaaggcuccguccaagcagaccuuacacuaauguucgacaacuucgaagucgacuucgucggcgccgccgucagcugcgacgccgccuuccugaaccucacgggcuguuacagcugcaacgccggcgcacgcgucugccuaucuaucaccucgaccggcacaggaucacuauccgcacacaacaaagacggaucgcuccacaucguacucccaagcgaaaacggcaccaaggaccagugccaaauccugcacuucaccguaccagaaguagaagaagaguucauguacucaugcgacggcgacgaaagaccacugcucgugaaaggcacccuuauagcgaucgacccauucgacgaccgacgagaagcaggaggcgaaucaacaguuguaaaccccaaaagcggaaguuggaacuucuucgacugguucagcgggcucaugagcugguucggaggaccacucaaaaccauacuccucaucugccucuacgucgcacucagcaucgggcuuuucuuccuccucaucuaccugggccgcaccggacuaucaaaaauguggcucgccgccaccaagaaagcaagcuaa

SEQ ID NO: 17281 - RNA, 955 nt, Artificial Sequence
  mRNA product Design1 comprising derived and/or modified sequence from RVFV(ZH-548)__DQ380151.1__N (wt)
gggagaaagcuuaccauggacaacuaucaagagcuugcgauccaguuugcugcucaagcaguggaccgcaaugagauugaacaguggguccgagaguuugcuuaucaaggguuugaugcccguagaguuaucgaacucuuaaagcaguaugguggggcugacugggagaaggaugccaagaaaaugauuguucuggcucuaacucguggcaacaagcccaggaggaugaugaugaaaaugucgaaagaaggcaaagcaacuguggaggcucucaucaacaaguauaagcuaaaggaagggaauccuucccgggaugaguugacucuaucacgaguugcugccgccuuggcuggcuggacaugccaggcuuuggucgucuugagugaguggcuuccugucacugggacuaccauggacggccuauccccugcauacccgaggcauaugaugcaccccagcuuugcuggcaugguggauccuucucuaccaggagacuaucuaagggcaauauuagaugcucacucucuguaucugcugcaguucucccgggucaucaacccaaaccuccgagguagaacaaaagaggagguugcugcaacguucacgcagccaaugaaugcagcagugaauagcaacuuuauaagccaugagaagaggagagaauucuugaaagccuuuggacuuguggauuccaaugggaagccgucagcugcugucauggcagccgcucaggcuuacaagacagcagccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17282 - RNA, 955 nt, Artificial Sequence
  mRNA product Design1 comprising derived and/or modified sequence from RVFV(ZH-548)__DQ380151.1__N (wt)
gggagaaagcuuaccauggacaacuaucaagagcuugcgauccaguuugcugcucaagcaguggaccgcaaugagauugaacaguggguccgagaguuugcuuaucaaggguuugaugcccguagaguuaucgaacucuuaaagcaguaugguggggcugacugggagaaggaugccaagaaaaugauuguucuggcucuaacucguggcaacaagcccaggaggaugaugaugaaaaugucgaaagaaggcaaagcaacuguggaggcucucaucaacaaguauaagcuaaaggaagggaauccuucccgggaugaguugacucuaucacgaguugcugccgccuuggcuggcuggacaugccaggcuuuggucgucuugagugaguggcuuccugucacugggacuaccauggacggccuauccccugcauacccgaggcauaugaugcaccccagcuuugcuggcaugguggauccuucucuaccaggagacuaucuaagggcaauauuagaugcucacucucuguaucugcugcaguucucccgggucaucaacccaaaccuccgagguagaacaaaagaggagguugcugcaacguucacgcagccaaugaaugcagcagugaauagcaacuuuauaagccaugagaagaggagagaguucuugaaagccuuuggacuuguggauuccaaugggaagccgucagcugcugucauggcagccgcucaggcuuacaagacagcagccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17283 - RNA, 3811 nt, Artificial Sequence
  mRNA product Design1 comprising derived and/or modified sequence from RVFV(ZH-548)__DQ380206.1__GP (wt)
gggagaaagcuuaccauguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17284 - RNA, 3811 nt, Artificial Sequence
  mRNA product Design1 comprising derived and/or modified sequence from RVFV(ZH-548)__DQ380206.1__GP (wt)
gggagaaagcuuaccauguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugucaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17285 - RNA, 3421 nt, Artificial Sequence
  mRNA product Design1 comprising derived and/or modified sequence from RVFV(ZH-548)__DQ380206.1__Gn-Gc (wt)
gggagaaagcuuaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17286 - RNA, 3421 nt, Artificial Sequence
  mRNA product Design1 comprising derived and/or modified sequence from RVFV(ZH-548)__DQ380206.1__Gn-Gc (wt)
gggagaaagcuuaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17287 - RNA, 3172 nt, Artificial Sequence
  mRNA product Design1 comprising derived and/or modified sequence from RVFV(ZH-548)__DQ380206.1__Gne_SP-Gn_Gc (wt)
gggagaaagcuuaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcuauggcagggauugcaaugacaguccuuccagccuuagcaguuuuugcuuuggcaccuguuguuuuugcugaagacuguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17288 - RNA, 3172 nt, Artificial Sequence
  mRNA product Design1 comprising derived and/or modified sequence from RVFV(ZH-548)__DQ380206.1__Gne_SP-Gn_Gc (wt)
gggagaaagcuuaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcuauggcagggauugcaaugacaguccuuccagccuuagcaguuuuugcuuuggcaccuguuguuuuugcugaagacuguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17289 - RNA, 3406 nt, Artificial Sequence
  mRNA product Design1 comprising derived and/or modified sequence from RVFV(ZH-548)__DQ380206.1__IgE-leader_Gn(delSP)-Gc-variant1 (wt)
gggagaaagcuuaccauggacuggaccuggauccuguuccucguggccgccgcgacccgcguccacagcgaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17290 - RNA, 3406 nt, Artificial Sequence
  mRNA product Design1 comprising derived and/or modified sequence from RVFV(ZH-548)__DQ380206.1__IgE-leader_Gn(delSP)-Gc-variant1 (wt)
gggagaaagcuuaccauggacuggaccuggauccuguuccucguggccgccgcgacccgcguccacagcgaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17291 - RNA, 3400 nt, Artificial Sequence
  mRNA product Design1 comprising derived and/or modified sequence from RVFV(ZH-548)__DQ380206.1__IgE-leader_Gn(delSP)-Gc-variant2 (wt)
gggagaaagcuuaccauggacuggaccuggauccuguuccucguggccgccgcgacccgcguccacagcccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17292 - RNA, 3400 nt, Artificial Sequence
  mRNA product Design1 comprising derived and/or modified sequence from RVFV(ZH-548)__DQ380206.1__IgE-leader_Gn(delSP)-Gc-variant2 (wt)
gggagaaagcuuaccauggacuggaccuggauccuguuccucguggccgccgcgacccgcguccacagcccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17293 - RNA, 1885 nt, Artificial Sequence
  mRNA product Design1 comprising derived and/or modified sequence from RVFV(ZH-548)__DQ380206.1__IgE-leader_Gn(delSP)-variant1 (wt)
gggagaaagcuuaccauggacuggaccuggauccuguuccucguggccgccgcgacccgcguccacagcgaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17294 - RNA, 1885 nt, Artificial Sequence
  mRNA product Design1 comprising derived and/or modified sequence from RVFV(ZH-548)__DQ380206.1__IgE-leader_Gn(delSP)-variant1 (wt)
gggagaaagcuuaccauggacuggaccuggauccuguuccucguggccgccgcgacccgcguccacagcgaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17295 - RNA, 1879 nt, Artificial Sequence
  mRNA product Design1 comprising derived and/or modified sequence from RVFV(ZH-548)__DQ380206.1__IgE-leader_Gn(delSP)-variant2 (wt)
gggagaaagcuuaccauggacuggaccuggauccuguuccucguggccgccgcgacccgcguccacagcccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17296 - RNA, 1879 nt, Artificial Sequence
  mRNA product Design1 comprising derived and/or modified sequence from RVFV(ZH-548)__DQ380206.1__IgE-leader_Gn(delSP)-variant2 (wt)
gggagaaagcuuaccauggacuggaccuggauccuguuccucguggccgccgcgacccgcguccacagcccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17297 - RNA, 1795 nt, Artificial Sequence
  mRNA product Design1 comprising derived and/or modified sequence from RVFV(ZH-548)__DQ380206.1__IgE-leader_Gc (wt)
gggagaaagcuuaccauggacuggaccuggauccuguuccucguggccgccgcgacccgcguccacagcuguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17298 - RNA, 1795 nt, Artificial Sequence
  mRNA product Design1 comprising derived and/or modified sequence from RVFV(ZH-548)__DQ380206.1__IgE-leader_Gc (wt)
gggagaaagcuuaccauggacuggaccuggauccuguuccucguggccgccgcgacccgcguccacagcuguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17299 - RNA, 955 nt, Artificial Sequence
  mRNA product Design1 comprising derived and/or modified sequence from RVFV(ZH-548)__DQ380151.1__N (opt4)
gggagaaagcuuaccauggacaacuaccaggagcuggccauccaguucgccgcccaggccguggacagaaacgagaucgagcagugggugagagaguucgccuaccagggcuucgacgccagaagagugaucgagcugcugaagcaguacggcggcgccgacugggagaaggacgccaagaagaugaucgugcuggcccugaccagaggcaacaagcccagaagaaugaugaugaagaugagcaaggagggcaaggccaccguggaggcccugaucaacaaguacaagcugaaggagggcaaccccagcagagacgagcugacccugagcagaguggccgccgcccuggccggcuggaccugccaggcccugguggugcugagcgaguggcugcccgugaccggcaccaccauggacggccugagccccgccuaccccagacacaugaugcaccccagcuucgccggcaugguggaccccagccugcccggcgacuaccugagagccauccuggacgcccacagccuguaccugcugcaguucagcagagugaucaaccccaaccugagaggcagaaccaaggaggagguggccgccaccuucacccagcccaugaacgccgccgugaacagcaacuucaucagccacgagaagagaagagaguuccugaaggccuucggccugguggacagcaacggcaagcccagcgccgccgugauggccgccgcccaggccuacaagaccgccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17300 - RNA, 3811 nt, Artificial Sequence
  mRNA product Design1 comprising derived and/or modified sequence from RVFV(ZH-548)__DQ380206.1__GP (opt4)
gggagaaagcuuaccauguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugucacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17301 - RNA, 3421 nt, Artificial Sequence
  mRNA product Design1 comprising derived and/or modified sequence from RVFV(ZH-548)__DQ380206.1__Gn-Gc (opt4)
gggagaaagcuuaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17302 - RNA, 3172 nt, Artificial Sequence
  mRNA product Design1 comprising derived and/or modified sequence from RVFV(ZH-548)__DQ380206.1__Gne_SP-Gn_Gc (opt4)
gggagaaagcuuaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgccauggccggcaucgccaugaccgugcugcccgcccuggccguguucgcccuggcccccgugguguucgccgaggacugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17303 - RNA, 3406 nt, Artificial Sequence
  mRNA product Design1 comprising derived and/or modified sequence from RVFV(ZH-548)__DQ380206.1__IgE-leader_Gn(delSP)-Gc-variant1 (opt4)
gggagaaagcuuaccauggacuggaccuggauccuguuccugguggccgccgccaccagagugcacagcgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17304 - RNA, 3400 nt, Artificial Sequence
  mRNA product Design1 comprising derived and/or modified sequence from RVFV(ZH-548)__DQ380206.1__IgE-leader_Gn(delSP)-Gc-variant2 (opt4)
gggagaaagcuuaccauggacuggaccuggauccuguuccugguggccgccgccaccagagugcacagcccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17305 - RNA, 1885 nt, Artificial Sequence
  mRNA product Design1 comprising derived and/or modified sequence from RVFV(ZH-548)__DQ380206.1__IgE-leader_Gn(delSP)-variant1 (opt4)
gggagaaagcuuaccauggacuggaccuggauccuguuccugguggccgccgccaccagagugcacagcgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17306 - RNA, 1879 nt, Artificial Sequence
  mRNA product Design1 comprising derived and/or modified sequence from RVFV(ZH-548)__DQ380206.1__IgE-leader_Gn(delSP)-variant2 (opt4)
gggagaaagcuuaccauggacuggaccuggauccuguuccugguggccgccgccaccagagugcacagcccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17307 - RNA, 1795 nt, Artificial Sequence
  mRNA product Design1 comprising derived and/or modified sequence from RVFV(ZH-548)__DQ380206.1__IgE-leader_Gc (opt4)
gggagaaagcuuaccauggacuggaccuggauccuguuccugguggccgccgccaccagagugcacagcugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17308 - RNA, 955 nt, Artificial Sequence
  mRNA product Design1 comprising derived and/or modified sequence from RVFV(ZH-548)__DQ380151.1__N (opt3)
gggagaaagcuuaccauggacaacuaccaggagcuggccauccaauucgcugcacaggccguggauagaaaugaaauugagcagugggucagggaauuugcguaucagggcuucgacgcucggcgcguuauagagcuccuuaagcaauacgggggagccgauugggaaaaagacgcaaagaaaaugaucgugcuggccuugacccgagguaacaagccccguagaaugaugaugaaaaugagcaaggagggcaaggcuacaguagaggcauuaauuaauaaauauaagcugaaagaagggaacccuuccagggaugagcuaacucucucucggguggccgcugcccuggcgggauggacgugccaggcacuugucgugcugucagaaugguugccaguuaccggcacaacuauggacggucucaguccggccuacccccgccacaugaugcauccuagcuuugcugggaugguggauccaucccugcccggagacuaucugagagccauccucgaugcacacucuuuauaccugcuucaguucucgagggucauuaauccuaacuugcggggccgcaccaaggaggagguggcugccacauuuacccagccaaugaaugcggccguaaacucaaauuucaucagccaugaaaaacgaagagaguuucugaaggcauucggccuaguugacaguaacgggaagcccuccgcugccgugauggcugccgcacaagccuauaaaacugcugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17309 - RNA, 3811 nt, Artificial Sequence
  mRNA product Design1 comprising derived and/or modified sequence from RVFV(ZH-548)__DQ380206.1__GP (opt3)
gggagaaagcuuaccauguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcugucagcccacggaaauccgugcaugaaggagaagcuagucaugaaaacgcauugucccaacgauuaucagagugcgcacuaccucaauaacgacgguaagauggccagcgugaaaugcccuccaaaguaugaacugacugaggacuguaauuucugccgacaaaugaccggcgcaucucuuaaaaagggguccuacccccugcaggauuuguuuugccagucaagcgaagacgauggaaguaaacucaagacaaagaugaaaggcgugugugaggucgguguucaggcucugaagaaaugcgacgggcaauuaucuacugcccaugaagugguaccuuucgcuguguuuaagaacuccaaaaaggucuaccuggauaagcucgaccuuaaaaccgaggagaaucuguugccagauagcuucguguguuuugaacacaagggacaguauaaaggcacaauggacucgggccagaccaagagagagcuaaaaucuuucgauauuucccagugccccaagaucgggggacacgguucaaagaaauguacgggcgacgccgcauuuugcagugccuacgaauguacugcucaauaugcgaacgcauacugcagccaugccaauggguccggaaucguucagauucaggugucuggcgucuggaagaaaccgcuguguguggguuaugagaggguaguugugaagcgggaacucagcgcuaaaccuauacaacgugucgagcccugcacaaccuguaucacuaagugcgagccacacgggcuggugguccgcucaacaggcuucaagauuaguuccgccguggcaugcgccagcggaguuugugugaccggcucucagucaccuaguacggaaaucacccuuaaauaccccgggauaagccaguccucuggaggugauauuggcguacauauggcucacgacgaccagucggucagcuccaagaucguggcccauugcccaccccaagauccuugucugguucacgacugcaucgugugugcacacggguugauuaacuaucagugccauacagcgcucucagcuuucgucgugguauuuguguucaguucuaucgccauuauaugucuggcaaucuuauacagaguucugaaaugccuaaagauugccccaaggaaaguccucaauccgcugauguggaucacugcuuuuauccgguggauuuacaagaaaaugguggcccgaguggcagauaacauaaaccaggucaaucgcgagaucggauggauggaaggcggucagcuuguuuuggggaaccccgcuccuauuccaagacacgcccccaucccuagguauagcaccuaccugaugcuccugcuuauuguguccuaugcgucagccuguagcgagcugauccaggcuucuucccggauaacaacuugcaguaccgagggcgugaauacaaagugucgcuugagcggaaccgcacucaucagagccggcucuguaggggcugaagccugccugauguuaaagggagucaaagaggaccaaacuaaguuccugaaaauuaagacgguguccucagaacuaaguugcagggagggucagagcuacuggacaggcucguuuuccccaaaaugucucucuagccgucggugccaucugguuggggaaugucacgugaaccgaugccuuucauggagagauaaugagaccagugcagaguucuccuuugucggagaaucuacuaccaugagggagaacaaguguuucgaacagugcggcgguuggggguguggcugcuuuaaugugaaccccagcuguuuguucguucacacauaucugcaauccgugcgcaaggaggcgcuccggguauuuaauugcaucgacuggguccauaaacugaccuuagaaauuacugauuucgacggaucagugagcacaaucgaucugggcgccaguucuuccagauuuacgaacugggggagcgugucgcuuucauuggacgcugagggaauaucuggcaguaauuccuucagcuucauugagucuccggguaagggguacgccaucgucgaugaaccuuuuagcgagauuccaaggcagggauuccucggcgaaauccgcuguaacuccgagucaaguguucugagcgcacacgaaucuugccuacgagcucccaaucugauauccuauaaaccuaugaucgaccagcucgagugcaccacuaaccugauugaucccuuugugguauucgagcgggguucacuuccacagacacguaaugacaagaccuuugccgcaaguaaaggcaacagaggggugcaagccuucagcaagggauccguccaggcugacuugacacugauguuugauaacuucgaaguggacuuuguuggcgcggccgugucuugugaugcagcuuucuuaaaucucacugggugcuacucguguaacgccggagccagggucugccugagcaucaccucaacgggcaccgguucccuuagugcucauaauaaggacgggucucugcacauuguguugccuagcgagaacggaacaaaagaucagugucaaauccuccauuuuacuguucccgaaguggaggaggaguucauguacuccugcgacggcgaugagcgcccacugcuagucaaggguacccugauagcaauugacccguuugaugaccggagagaagccggcggggagucaacaguagugaauccuaaaucuggaagcuggaacuucuucgauugguuuaguggccucauguccugguucgggggaccccugaagacuauccuuuugaucugucuguauguugcguuaagcauuggccucuuuuuccugcuuaucuaccuggguaggaccgggcuaucuaaaauguggcucgcugccacgaagaaggcaucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17310 - RNA, 3421 nt, Artificial Sequence
  mRNA product Design1 comprising derived and/or modified sequence from RVFV(ZH-548)__DQ380206.1__Gn-Gc (opt3)
gggagaaagcuuaccauggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcuuagugcgcauggaaacccuuguaugaaagagaagcuggugaugaagacucacugcccaaaugauuaucagagcgcacacuacuugaacaaugacggcaaaauggccuccguuaagugucccccuaaauaugaacucaccgaggauugcaacuuuugucgccagaugacaggugcuucucugaagaaagggucguacccacugcaggaccucuucugccaaucaagcgaggaugacggaaguaaguuaaagaccaaaaugaagggcgugugugaagucggcgugcaggcccugaaaaagugcgaugggcagcuuuccacugcacaugagguaguuccguuugcuguguucaaaaauucuaagaaagucuauuuggacaagcuggaccuaaagacagaagagaaccuccugcccgauagcuuuguguguuucgagcacaaaggacaguacaaggguaccauggacuccggccaaacgaaacgagaacuuaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcagauccaagucagcggcguuuggaaaaagccacugugcgugggcuaugaacguguaguggucaaaagagaguugagugccaagcccauacagaggguggaaccuuguacaacuugcaucaccaaaugugagccacacgggcucguugugcggucuacaggauuuaagauuuccagcgcagucgccugcgcuucggguguguguguaaccggcucucagucccccucaacggagaucacucugaaguacccggggauuagucaaagcuccggaggcgauaucgguguucauauggcgcacgacgaucagucugugagcucaaaaauagucgcacauugcccuccccaggacccauguuuagugcacgauugcauugucugcgcccaugggcugaucaauuaucagugucacacagcucucagugccuucgugguuguguucguauuuuccagcauugcaaucaucugccuugccauucuguaccgcgucuugaagugucuaaaaauagcuccuagaaaggugcugaacccccucauguggaucaccgccuucauuagguggaucuauaaaaagaugguugcacggguggcggacaauauaaaccaagucaaucgcgaaauuggcuggauggagggaggccagcuggugcuugggaacccagcucccaucccucgacacgccccaaucccgagauacucuacuuaccugauguugcuccugauuguaucauaugcaagugccugcagcgaauuaauccaggcuuccucuaggauuacaaccuguucgacggagggagugaacaccaagugccggcugagcgguacagcccuaauacgugcaggcuccguuggggcugaagccugucucaugcugaaaggagucaaggaggaucagacuaaauuucuuaagaucaaaaccgugucaagugaguugucuugccgcgaaggccaaagcuacuggacagguuccuucucacccaagugucugagcucuagaaggugccaucucgugggggagugucacgucaaucggugccuguccuggcgagacaacgaaaccagugcggaguuuagcuucguuggcgaaucuacuacaaugcgcgagaauaaaugcuuugagcaguguggaggcugggggugcggauguuucaacgugaauccuuccugccuuuuugugcauaccuaucugcagucaguaagaaaggaagccuugagggucuucaacuguauugacugggugcacaagcucacucuggagaucacggauuuugacgguaguguuagcacaaucgauuuaggcgcuucguccucucgguucaccaauugggggagcgugucacugagucuagacgcagaaggaauuuccggcucuaacagcuuuuccuucauagagucaccagguaaaggguacgccaucgucgaugagcccuucagcgaaauuccucgccagggcuuucucggagagaucagaugcaauagugaaucuuccgugcugagcgcucacgagucgugucuuagggccccaaacuugauuucauauaagcccaugaucgaccaacuggaaugcacuaccaaucucauagauccguucguuguguuugagcguggcucucugccucagacacggaacgacaaaaccuucgcagcgaguaaggggaaucgaggaguacaggccuuuuccaaaggcagcguccaggcugauuuaacucugauguucgacaacuuugagguggauuucgugggugccgcagucucuugugacgcugccuuucuuaauuugacagggugcuacagcuguaacgcaggagccagaguuugccucuccaucacgucaaccggcacugguagucugagcgcucauaacaaggauggcucucuacacauugugcugccauccgaaaaugggacaaaggaccaaugccagauccuccauuucaccguacccgagguggaagaggaauuuauguauucaugugacggagaugagaggccucugcuugucaaaggcacauugauugcgaucgaccccuucgaugaccgccgggaggccgggggagaaaguacugugguuaacccaaagagcggcuccuggaacuuuuucgauugguucucuggucugaugucgugguuugggggaccuuuaaaaaccauacuccugauuugccuuuacguggcacugagcaucggcuuguucuuucuccugauuuaccuagguagaacgggccugucaaagauguggcucgcugccaccaaaaaggccuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17311 - RNA, 3172 nt, Artificial Sequence
  mRNA product Design1 comprising derived and/or modified sequence from RVFV(ZH-548)__DQ380206.1__Gne_SP-Gn_Gc (opt3)
gggagaaagcuuaccauggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcuuagugcgcauggaaacccuuguaugaaagagaagcuggugaugaagacucacugcccaaaugauuaucagagcgcacacuacuugaacaaugacggcaaaauggccuccguuaagugucccccuaaauaugaacucaccgaggauugcaacuuuugucgccagaugacaggugcuucucugaagaaagggucguacccacugcaggaccucuucugccaaucaagcgaggaugacggaaguaaguuaaagaccaaaaugaagggcgugugugaagucggcgugcaggcccugaaaaagugcgaugggcagcuuuccacugcacaugagguaguuccguuugcuguguucaaaaauucuaagaaagucuauuuggacaagcuggaccuaaagacagaagagaaccuccugcccgauagcuuuguguguuucgagcacaaaggacaguacaaggguaccauggacuccggccaaacgaaacgagaacuuaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcagauccaagucagcggcguuuggaaaaagccacugugcgugggcuaugaacguguaguggucaaaagagaguugagugccaagcccauacagaggguggaaccuuguacaacuugcaucaccaaaugugagccacacgggcucguugugcggucuacaggauuuaagauuuccagcgcagucgccugcgcuucggguguguguguaaccggcucucagucccccucaacggagaucacucugaaguacccggggauuagucaaagcuccggaggcgauaucgguguucauauggcgcacgacgaucagucugugagcucaaaaauagucgcacauugcccuccccaggacccauguuuagugcacgauugcauugucugcgcccaugggcugaucaauuaucagugucacacagcuauggccggcauugcaaugaccgugcucccugcccuugcuguuuucgcccuggcacccgugguauucgcggaagacugcagugaguugauccaagcuagcagccgcaucacuacauguucuaccgaaggagucaacacgaagugcagacuaucaggcaccgcccugauuagggcagggagugugggagccgaggcuugucucaugcugaaagguguuaaggaagaucagacaaaauuucuuaagauaaagacugugagcuccgagcugucuugccgggagggccagucguacuggaccgggagcuucuccccaaaauguuugucaagucgccgaugccaccucgucggagaaugucaugugaauagaugccugucuuggagggacaacgagacaagcgccgaauuuuccuucguaggcgagucaacuaccaugcgggaaaauaaguguuuugagcagugcgguggguggggcugcggauguuucaacgugaaccccagcugcuuauuuguucacacauaucugcaaucuguccguaaagaggcacuacgcguguucaauuguaucgacugggugcauaagcucacccuggaaauuacugauuuugacggcuccgucaguacgaucgaucuuggggcuuccucuuccagauucacaaacuggggaucaguuaguuugagccuggacgccgaggguauaucgggcuccaauucuuuuagcuucauugaaucaccugggaaaggauacgcgaucguggaugagccauuuagugagaucccgaggcagggcuuccucggugaaauucggugcaacuccgagucuagcgugcuguccgcccacgaaucaugucuucgagcucccaaucugaucagcuacaagccuaugauugaccaguuggagugcaccacuaaccucauagauccauucguagucuuugaacgcgggagucugccccagaccagaaaugacaaaacauucgcagccucuaagggcaacaggggagugcaggcuuuuuccaagggcagcguucaagccgauuuaacccugauguucgacaauuuugagguggauuucgucggggcagcggugucgugugacgccgcuuuucuaaaccucacuggaugcuauucauguaaugccggcgcacggguuugccugucuaucacaaguacggguaccgggucccuuagcgcucacaacaaagauggaucuuugcauauugugcugccuagcgagaauggcacuaaggaccagugucagauccuccacuucacaguaccagaagucgaggaagaguuuauguacuccugcgacggugaugaacgcccccuguuagugaaaggcacccugaucgccauugacccguucgaugacagaagggaggcagggggagagucaacaguggucaacccuaagaguggcagcuggaacuuuuucgauugguuuucugggcuuauguccugguucggaggcccauugaaaacuauacuccugaucugccuauauguugcccugucaauuggucucuucuuucugcuuaucuacuuggggcguaccggacugaguaagaugugguuagcugcgacgaagaaagccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17312 - RNA, 3406 nt, Artificial Sequence
  mRNA product Design1 comprising derived and/or modified sequence from RVFV(ZH-548)__DQ380206.1__IgE-leader_Gn(delSP)-Gc-variant1 (opt3)
gggagaaagcuuaccauggacuggacauggauccuguuccucguggccgcugcaacaagaguccacagcgaggauccccaucuuaggaaccggccuggcaaggggcacaauuacauugacggaaugacucaggaagaugccacgugcaaaccaguuaccuaugcgggugcuuguuccucuuuugacgugcuguuggagaagggcaaauucccguuauuucaaucauacgcccaucaccgcacacugcuagaagcaguacaugauacuauaaucgccaaggcugaucccccuaguugcgaccuccugagcgcacacgggaacccauguaugaaagagaaacuugugaugaagacccacugccccaaugacuaucaguccgcccauuaccugaacaaugauggaaaaauggcuucugucaaguguccuccaaaauaugaauugacagaggacugcaacuucugucgacagaugaccggcgccucgcucaagaaagguucauacccccugcaggaucuguuuugccaaagcagugaggacgauggguccaagcucaagacuaaaaugaagggagugugugaaguuggcgugcaggcguuaaagaagugcgacggccagcugucuacagcacacgaggucgugccuuucgccguauuuaaaaauagcaagaaaguuuaucuugacaaguuggaucugaagaccgaagagaaccuacucccagacuccuucguguguuuugagcauaaagggcaguacaagggaacgauggauucaggucaaacuaaacgugaacugaagaguuucgacauuagccagugcccgaaaaucggcgggcacggaucuaagaagugcaccggcgaugcugccuuuuguuccgcauacgagugcacagcucaguaugccaaugcguacuguucacacgccaacgguagcgggauuguccagauccaagugaguggaguguggaaaaagccccuuugcgucggcuaugaaagaguugugguaaaaagggagcugucugcaaagccuauacagcggguggaaccauguacuaccugcaucacaaaaugugagccccauggcuuggucgugcgcuccaccggguucaagauuagcucggcuguugccugcgcuucuggagugugugucacggguucccagucaccuaguacugagaucacacucaaguacccaggcauuagccaauccucugggggagacaucggcgugcacauggcccaugaugaccagagcguaucaaguaaaauaguugcacacugucccccgcaggauccuugccuggugcaugacugcauugucugcgcccacgguuuaaucaauuaucagugucacaccgcucuguccgcguuuguggucguguucguuuucagcucuauugcaaucaucugccucgccauucuuuacagagugcugaaguguuugaaaauagcucccaggaagguacuaaacccacugauguggaucacugccuuuauucgguggaucuauaaaaagauggucgcacgcguggccgauaauauaaaccaaguuaaucgagaaauuggguggauggagggcggacagcucgugcugggcaacccugcucccaucccaagacaugcccccaucccuagguacucaacauaccuuaugcuguugcucauugucaguuaugcaagcgcgugcuccgaacugauccaggcuucuucgcggauuaccacguguagcaccgagggggugaacacaaagugccguuuauccggaacugcccugauacgcgcagguucaguaggcgccgaggcuugucuaaugcucaaaggggugaaggaagaccagaccaaauuccugaagaucaaaacaguuaguucugagcuuagcugcagagaaggacaauccuacuggacuggcucauuuagcccaaaguguuugucuuccaggcggugccaccuggucggugagugucaugugaaucgaugccucaguuggcgcgacaacgaaaccagcgccgaguucucuuuugugggggaauccacaaccaugagagagaauaaaugcuucgagcaguguggcggauggggcugcggguguuuuaacgucaauccgucaugccuguucguucacacuuaucuucagagugugaggaaggaagcacugcggguguuuaacuguauugauuggguacacaaguugacgcucgagaucacagacuucgauggaagcgucucgaccaucgaccugggugcuuccucuagccgcuuuacuaauuggggcucagugaguuuaucccuggaugccgaagggauuucuggaagcaacuccuucucauuuauagagagccccggcaaagguuacgcgaucguugacgagccuuucagugaaauuccaagacagggguuccuaggcgagaucaggugcaauucugaauccagcgugcucucggcccaugagucaugucugcgugcucccaaccuuauuucuuauaagccuaugaucgaucaauuggaaugcaccacaaaucugauagacccauuugucguguucgagcggggaagucucccccagacccgaaacgauaaaacuuuugcagccuccaagggcaauagagggguucaggcuuucagcaaaggaucugugcaggccgaccugacauuaauguuugauaacuucgagguagacuuugucggcgcagcggugagcugugaugccgcuuuccugaaucuuacggguugcuacuccuguaacgccggggcaagggugugcuugucaaucaccaguacuggaacaggcagccucucugcucacaacaaggacgguucccugcauauuguccuaccgucagaaaauggcaccaaggaccaaugccagauccugcacuuuacaguuccugagguggaagaggaguucauguauaguugugauggggacgaacgcccacuccugguaaaaggaacucuuauugccaucgaucccuuugacgaucggagagaggcaggcggggaaagcaccguggucaacccuaaguccggaucuuggaauuucuuugacugguucucgggcuugaugagcugguucggugggccccugaaaacgauauuacucauuugccuguacguggcccuuucaaucggacuguuuuucuugcucauuuaccugggcaggaccggucuauccaagauguggcuggcugcgaccaaaaaggccaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17313 - RNA, 3400 nt, Artificial Sequence
  mRNA product Design1 comprising derived and/or modified sequence from RVFV(ZH-548)__DQ380206.1__IgE-leader_Gn(delSP)-Gc-variant2 (opt3)
gggagaaagcuuaccauggacuggacauggauccuguuccucguggccgcugcaacaagaguccacagcccccaucuuaggaaccggccuggcaaggggcacaauuacauugauggaaugacucaggaggacgccacgugcaaaccaguuaccuaugcgggugcuuguuccucuuuugaugugcuguuggaaaagggcaaauucccguuauuucaaucauacgcccaucaccgcacacugcuagaggcaguacaugacacuauaaucgccaaggcugaucccccuaguugcgaccuccugagcgcacacgggaacccauguaugaaagaaaaacuugugaugaagacccacugccccaaugauuaucaguccgcccauuaccugaacaaugacggaaaaauggcuucugucaaguguccuccaaaauaugaguugacagaagauugcaacuucugucgacagaugaccggcgccucgcucaagaaagguucauacccccugcaggaccuguuuugccaaagcagugaggaugacggguccaagcucaagacuaaaaugaagggagugugugagguuggcgugcaggcguuaaagaagugcgauggccagcugucuacagcacacgaagucgugccuuucgccguauuuaaaaauagcaagaaaguuuaucuugacaaguuggaccugaagaccgaggaaaaccuacucccagauuccuucguguguuuugagcauaaagggcaguacaagggaacgauggacucaggucaaacuaaacgugagcugaagaguuucgauauuagccagugcccgaaaaucggcgggcacggaucuaagaagugcaccggcgacgcugccuuuuguuccgcauacgaaugcacagcucaguaugccaaugcguacuguucacacgccaacgguagcgggauuguccagauccaagugaguggaguguggaaaaagccccuuugcgucggcuaugagagaguugugguaaaaagggaacugucugcaaagccuauacagcggguggagccauguacuaccugcaucacaaaaugugaaccccauggcuuggucgugcgcuccaccggguucaagauuagcucggcuguugccugcgcuucuggagugugugucacggguucccagucaccuaguacugagaucacacucaaguacccaggcauuagccaauccucugggggagauaucggcgugcacauggcccaugacgaucagagcguaucaaguaaaauaguugcacacugucccccgcaggacccuugccuggugcaugauugcauugucugcgcccacgguuuaaucaauuaucagugucacaccgcucuguccgcguuuguggucguguucguuuucagcucuauugcaaucaucugccucgccauucuuuacagagugcugaaguguuugaaaauagcucccaggaagguacuaaacccacugauguggaucacugccuuuauucgguggaucuauaaaaagauggucgcacgcguggccgacaauauaaaccaaguuaaucgagagauuggguggauggaaggcggacagcucgugcugggcaacccugcucccaucccaagacaugcccccaucccuagguacucaacauaccuuaugcuguugcucauugucaguuaugcaagcgcgugcuccgagcugauccaggcuucuucgcggauuaccacguguagcaccgaaggggugaacacaaagugccguuuauccggaacugcccugauacgcgcagguucaguaggcgccgaggcuugucuaaugcucaaaggggugaaggaagaucagaccaaauuccugaagaucaaaacaguuaguucugagcuuagcugcagagagggacaauccuacuggacuggcucauuuagcccaaaguguuugucuuccaggcggugccaccuggucggugaaugucaugugaaucgaugccucaguuggcgcgacaacgagaccagcgccgaguucucuuuugugggggaauccacaaccaugagagaaaauaaaugcuucgagcaguguggcggauggggcugcggguguuuuaacgucaauccgucaugccuguucguucacacuuaucuucagagugugaggaaggaggcacugcggguguuuaacuguauugacuggguacacaaguugacgcucgaaaucacagauuucgacggaagcgucucgaccaucgaucugggugcuuccucuagccgcuuuacuaauuggggcucagugaguuuaucccuggacgccgaggggauuucuggaagcaacuccuucucauuuauagaaagccccggcaaagguuacgcgaucguugaugagccuuucagugagauuccaagacagggguuccuaggcgaaaucaggugcaauucugaguccagcgugcucucggcccaugaaucaugucugcgugcucccaaccuuauuucuuauaagccuaugaucgaccaauuggagugcaccacaaaucugauagauccauuugucguguucgaacggggaagucucccccagacccgaaacgacaaaacuuuugcagccuccaagggcaauagagggguucaggcuuucagcaaaggaucugugcaggccgaucugacauuaauguuugacaacuucgagguagauuuugucggcgcagcggugagcugugacgccgcuuuccugaaucuuacggguugcuacuccuguaacgccggggcaagggugugcuugucaaucaccaguacuggaacaggcagccucucugcucacaacaaggaugguucccugcauauuguccuaccgucagagaauggcaccaaggaccaaugccagauccugcacuuuacaguuccugaaguggaggaagaguucauguauaguugugacggggaugaacgcccacuccugguaaaaggaacucuuauugccaucgaccccuuugaugaccggagagaggcaggcggggagagcaccguggucaacccuaaguccggaucuuggaauuucuuugauugguucucgggcuugaugagcugguucggugggccccugaaaacgauauuacucauuugccuguacguggcccuuucaaucggacuguuuuucuugcucauuuaccugggcaggaccggucuauccaagauguggcuggcugcgaccaaaaaggccaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17314 - RNA, 1885 nt, Artificial Sequence
  mRNA product Design1 comprising derived and/or modified sequence from RVFV(ZH-548)__DQ380206.1__IgE-leader_Gn(delSP)-variant1 (opt3)
gggagaaagcuuaccauggacuggaccuggauccuguuccucguggccgcugcaacaagaguccacagcgaggauccccaucuuaggaaccggccuggcaaggggcacaauuacauugacggaaugacucaggaagaugccacgugcaaaccaguuaccuaugcgggugcuuguuccucuuuugacgugcuguuggagaagggcaaauucccguuauuucaaucauacgcccaucaccgcacacugcuagaagcaguacaugauacuauaaucgccaaggcugaucccccuaguugcgaccuccugagcgcacacgggaacccauguaugaaagagaaacuugugaugaagacccacugccccaaugacuaucaguccgcccauuaccugaacaaugauggaaaaauggcuucugucaaguguccuccaaaauaugaauugacagaggacugcaacuucugucgacagaugaccggcgccucgcucaagaaagguucauacccccugcaggaucuguuuugccaaagcagugaggacgauggguccaagcucaagacuaaaaugaagggagugugugaaguuggcgugcaggcguuaaagaagugcgacggccagcugucuacagcacacgaggucgugccuuucgccguauuuaaaaauagcaagaaaguuuaucuugacaaguuggaucugaagaccgaagagaaccuacucccagacuccuucguguguuuugagcauaaagggcaguacaagggaacgauggauucaggucaaacuaaacgugaacugaagaguuucgacauuagccagugcccgaaaaucggcgggcacggaucuaagaagugcaccggcgaugcugccuuuuguuccgcauacgagugcacagcucaguaugccaaugcguacuguucacacgccaacgguagcgggauuguccagauccaagugaguggaguguggaaaaagccccuuugcgucggcuaugaaagaguugugguaaaaagggagcugucugcaaagccuauacagcggguggaaccauguacuaccugcaucacaaaaugugagccccauggcuuggucgugcgcuccaccggguucaagauuagcucggcuguugccugcgcuucuggagugugugucacggguucccagucaccuaguacugagaucacacucaaguacccaggcauuagccaauccucugggggagacaucggcgugcacauggcccaugaugaccagagcguaucaaguaaaauaguugcacacugucccccgcaggauccuugccuggugcaugacugcauugucugcgcccacgguuuaaucaauuaucagugucacaccgcucuguccgcguuuguggucguguucguuuucagcucuauugcaaucaucugccucgccauucuuuacagagugcugaaguguuugaaaauagcucccaggaagguacuaaacccacugauguggaucacugccuuuauucgguggaucuauaaaaagauggucgcacgcguggccgauaauauaaaccaaguuaaucgagaaauuggguggauggagggcggacagcucgugcugggcaacccugcucccaucccaagacaugcccccaucccuagguacucaacauaccuuaugcuguugcucauugucaguuaugcaagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17315 - RNA, 1879 nt, Artificial Sequence
  mRNA product Design1 comprising derived and/or modified sequence from RVFV(ZH-548)__DQ380206.1__IgE-leader_Gn(delSP)-variant2 (opt3)
gggagaaagcuuaccauggacuggaccuggauccuguuccucguggccgcugcaacaagaguccacagcccccaucuuaggaaccggccuggcaaggggcacaauuacauugauggaaugacucaggaggacgccacgugcaaaccaguuaccuaugcgggugcuuguuccucuuuugaugugcuguuggaaaagggcaaauucccguuauuucaaucauacgcccaucaccgcacacugcuagaggcaguacaugacacuauaaucgccaaggcugaucccccuaguugcgaccuccugagcgcacacgggaacccauguaugaaagaaaaacuugugaugaagacccacugccccaaugauuaucaguccgcccauuaccugaacaaugacggaaaaauggcuucugucaaguguccuccaaaauaugaguugacagaagauugcaacuucugucgacagaugaccggcgccucgcucaagaaagguucauacccccugcaggaccuguuuugccaaagcagugaggaugacggguccaagcucaagacuaaaaugaagggagugugugagguuggcgugcaggcguuaaagaagugcgauggccagcugucuacagcacacgaagucgugccuuucgccguauuuaaaaauagcaagaaaguuuaucuugacaaguuggaccugaagaccgaggaaaaccuacucccagauuccuucguguguuuugagcauaaagggcaguacaagggaacgauggacucaggucaaacuaaacgugagcugaagaguuucgauauuagccagugcccgaaaaucggcgggcacggaucuaagaagugcaccggcgacgcugccuuuuguuccgcauacgaaugcacagcucaguaugccaaugcguacuguucacacgccaacgguagcgggauuguccagauccaagugaguggaguguggaaaaagccccuuugcgucggcuaugagagaguugugguaaaaagggaacugucugcaaagccuauacagcggguggagccauguacuaccugcaucacaaaaugugaaccccauggcuuggucgugcgcuccaccggguucaagauuagcucggcuguugccugcgcuucuggagugugugucacggguucccagucaccuaguacugagaucacacucaaguacccaggcauuagccaauccucugggggagauaucggcgugcacauggcccaugacgaucagagcguaucaaguaaaauaguugcacacugucccccgcaggacccuugccuggugcaugauugcauugucugcgcccacgguuuaaucaauuaucagugucacaccgcucuguccgcguuuguggucguguucguuuucagcucuauugcaaucaucugccucgccauucuuuacagagugcugaaguguuugaaaauagcucccaggaagguacuaaacccacugauguggaucacugccuuuauucgguggaucuauaaaaagauggucgcacgcguggccgacaauauaaaccaaguuaaucgagagauuggguggauggaaggcggacagcucgugcugggcaacccugcucccaucccaagacaugcccccaucccuagguacucaacauaccuuaugcuguugcucauugucaguuaugcaagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17316 - RNA, 1795 nt, Artificial Sequence
  mRNA product Design1 comprising derived and/or modified sequence from RVFV(ZH-548)__DQ380206.1__IgE-leader_Gc (opt3)
gggagaaagcuuaccauggacuggaccuggauccuguuccucguggccgcugcaacaagaguccacagcugcuccgagcuuauucaggccucuucaaggauaacuacguguaguaccgaaggcguuaauacaaagugccggcugagcgggacugcguugauccgcgcuggauccgugggugccgaggcauguuuaaugcugaaaggcguaaaggaagaucaaaccaaauuucuaaagauuaaaacagugucuucggagcucucaugccgagaagggcagagcuacuggaccggaaguuucucccccaagugucugucuagccguagaugccaucuugucggcgagugucacgugaauaggugccuguccuggcgggacaacgagacuucagccgaauuuaguuucguuggugagagcacaaccaugcgcgaaaauaaguguuuugagcagugcgggggauggggcuguggcugcuucaacgugaauccuucuugcuuguuuguccauacguaucuccaguccgugagaaaagaggcucugaggguauucaacuguaucgauuggguucacaagcugacucucgaaauuaccgacuuugaugggucagugagcacaaucgacuuaggagcaaguucuucccgguucacuaauugggguagcgucucgcugucucuugaugccgagggcauauccgggucaaacaguuuuagcuucaucgaauccccaggaaaaggcuacgcuauuguggacgagccguuuucugaaaucccccgccaagguuucuugggggagauucgaugcaauagcgagucaagugugcuguccgcccaugaaagcugucuaagagcgccuaaccucaucucuuauaagccaaugauagaucagcuggagugcaccacaaaucuuauugaccccuucgucguuuuugaaaggggaucacugccucagacccggaacgauaaaacguucgcagccaguaagggcaaucguggcgugcaggcuuuuagcaagggguccguacaagccgacuugacucucauguucgauaacuuugagguggacuucgucggagcagcugugucuugugacgccgcguuucugaauuuaacagguugcuacucguguaacgccggcgcacgcguuugccugagcaucaccuccacugggacaggaucacucagugcucacaacaaagauggcucucuucacauugugcugccaagcgaaaaugguaccaaggaccagugucagaucuugcauuucacgguccccgagguggaggaagaguuuauguauuccugcgauggggacgaaagaccucuacugguaaaaggcacccucaucgccauugauccauucgacgauaggcgggaggcuggaggcgaaucaacaguugugaacccgaaaagcgggucuuggaacuuuuucgacugguuuuccggacugaugaguugguucgguggcccccuuaaaacuauacuguugaucugucucuacgucgcccugagcauuggguuauucuuucugcuaaucuaucucggacgaaccggccugucuaagauguggcuugcagccacaaagaaggcuuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17317 - RNA, 955 nt, Artificial Sequence
  mRNA product Design1 comprising derived and/or modified sequence from RVFV(ZH-548)__DQ380151.1__N (opt1)
gggagaaagcuuaccauggacaacuaccaggagcuggccauccaguucgccgcgcaggccguggaccgcaacgagaucgagcaguggguccgggaguucgccuaccagggcuucgacgcccgccgggugaucgagcuccugaagcaguacgggggcgccgacugggagaaggacgcgaagaagaugaucgugcuggcccucacccgcgggaacaagccccggcgcaugaugaugaagaugagcaaggagggcaaggccaccgucgaggcccugaucaacaaguacaagcugaaggaggggaacccgucccgggacgagcucacgcugagccgcguggcggccgcccuggccggcuggaccugccaggcccucgugguccuguccgaguggcugcccgugaccggcaccacgauggacgggcucagccccgcguacccccggcacaugaugcacccguccuucgccggcaugguggaccccagccugcccggggacuaccugcgcgccauccucgacgcccacucccuguaccugcuccaguucagccgggucaucaaccccaaccugcgcggccggaccaaggaggagguggccgcgaccuucacccagccgaugaacgccgccgugaacuccaacuucaucagccacgagaagcgccgggaguuccugaaggccuucgggcucgucgacuccaacggcaagcccagcgccgcggugauggccgccgcccaggccuacaagacggcggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17318 - RNA, 3811 nt, Artificial Sequence
  mRNA product Design1 comprising derived and/or modified sequence from RVFV(ZH-548)__DQ380206.1__GP (opt1)
gggagaaagcuuaccauguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17319 - RNA, 3421 nt, Artificial Sequence
  mRNA product Design1 comprising derived and/or modified sequence from RVFV(ZH-548)__DQ380206.1__Gn-Gc (opt1)
gggagaaagcuuaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17320 - RNA, 3172 nt, Artificial Sequence
  mRNA product Design1 comprising derived and/or modified sequence from RVFV(ZH-548)__DQ380206.1__Gne_SP-Gn_Gc (opt1)
gggagaaagcuuaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggccauggcggggaucgccaugaccgugcugcccgcccuggccguguucgcgcucgcccccgucguguucgccgaggacugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17321 - RNA, 3406 nt, Artificial Sequence
  mRNA product Design1 comprising derived and/or modified sequence from RVFV(ZH-548)__DQ380206.1__IgE-leader_Gn(delSP)-Gc-variant1 (opt1)
gggagaaagcuuaccauggacuggaccuggauccuguuccucguggccgccgcgacccgcguccacagcgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17322 - RNA, 3400 nt, Artificial Sequence
  mRNA product Design1 comprising derived and/or modified sequence from RVFV(ZH-548)__DQ380206.1__IgE-leader_Gn(delSP)-Gc-variant2 (opt1)
gggagaaagcuuaccauggacuggaccuggauccuguuccucguggccgccgcgacccgcguccacagcccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17323 - RNA, 1885 nt, Artificial Sequence
  mRNA product Design1 comprising derived and/or modified sequence from RVFV(ZH-548)__DQ380206.1__IgE-leader_Gn(delSP)-variant1 (opt1)
gggagaaagcuuaccauggacuggaccuggauccuguuccucguggccgccgcgacccgcguccacagcgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17324 - RNA, 1879 nt, Artificial Sequence
  mRNA product Design1 comprising derived and/or modified sequence from RVFV(ZH-548)__DQ380206.1__IgE-leader_Gn(delSP)-variant2 (opt1)
gggagaaagcuuaccauggacuggaccuggauccuguuccucguggccgccgcgacccgcguccacagcccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17325 - RNA, 1795 nt, Artificial Sequence
  mRNA product Design1 comprising derived and/or modified sequence from RVFV(ZH-548)__DQ380206.1__IgE-leader_Gc (opt1)
gggagaaagcuuaccauggacuggaccuggauccuguuccucguggccgccgcgacccgcguccacagcugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17326 - RNA, 955 nt, Artificial Sequence; identical to SEQ ID NO: 17317
  mRNA product Design1 comprising derived and/or modified sequence from RVFV(ZH-548)__DQ380151.1__N (opt1)

SEQ ID NO: 17327 - RNA, 3811 nt, Artificial Sequence; identical to SEQ ID NO: 17318
  mRNA product Design1 comprising derived and/or modified sequence from RVFV(ZH-548)__DQ380206.1__GP (opt1)

SEQ ID NO: 17328 - RNA, 3421 nt, Artificial Sequence
  mRNA product Design1 comprising derived and/or modified sequence from RVFV(ZH-548)__DQ380206.1__Gn-Gc (opt1)
gggagaaagcuuaccauggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcucagcgcccacggcaaccccugcaugaaggagaagcuggucaugaagacgcacugccccaacgacuaccaguccgcccacuaccugaacaacgacggcaagauggcgagcgugaagugcccgcccaaguacgagcucaccgaggacugcaacuucugccggcagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacgcugaaguacccggggaucagccaguccagcggcggggacaucggcguccacauggcccacgacgaccaguccgugagcuccaagaucguggcccacugcccgccccaggaccccugccugguccacgacugcaucgugugcgcccacggccucaucaacuaccagugccacaccgcgcugagcgccuucguggucguguucguguucuccagcaucgccaucaucugccuggccauccucuaccggguccugaagugccugaagaucgcgccccgcaaggugcucaacccccugauguggaucaccgccuucauccgguggaucuacaagaagaugguggcccgcgucgccgacaacaucaaccaggugaaccgggagaucggguggauggagggcgggcagcuggugcucggcaaccccgcccccaucccgcgccacgcccccaucccccgguacuccaccuaccugaugcugcuccugaucgucagcuacgcgagcgccugcuccgagcugauccaggccagcucccgcaucacgaccugcagcaccgagggggugaacaccaagugccggcucuccggcacggcccugauccgcgccggcagcgugggggcggaggccugccugaugcucaagggcgucaaggaggaccagaccaaguuccugaagaucaagaccguguccagcgagcuguccugccgggaggggcagagcuacuggaccggcuccuucagcccgaagugccuguccagccgccggugccaccucgugggcgagugccacgucaaccgcugccuguccuggcgcgacaacgagacgagcgccgaguucuccuucgugggggagagcaccaccaugcgggagaacaagugcuucgagcagugcggcggguggggcugcgggugcuucaacgugaaccccagcugccuguucguccacaccuaccuccaguccgugcgcaaggaggcccugcggguguucaacugcaucgacuggguccacaagcugacgcucgagaucaccgacuucgacggcagcguguccaccaucgaccugggcgcgagcuccagccgcuucaccaacuggggguccgugagccugucccucgacgccgagggcaucagcggguccaacagcuucuccuucaucgagagccccggcaagggguacgccaucgucgacgagcccuucuccgagaucccgcggcagggcuuccugggcgagauccgcugcaacagcgaguccagcgugcuguccgcccacgagagcugccuccgggcccccaaccugaucagcuacaagcccaugaucgaccagcuggagugcaccacgaaccucaucgaccccuucguggucuucgagcgcgggucccugccgcagacccggaacgacaagaccuucgcggccagcaagggcaaccgcggggugcaggccuucuccaagggcagcgugcaggccgaccugacccucauguucgacaacuucgaggucgacuucgugggggccgcgguguccugcgacgccgccuuccugaaccugacgggcugcuacagcugcaacgccggcgcccgggucugccucuccaucaccagcaccgggaccggcucccugagcgcgcacaacaaggacgggucccugcacaucgugcuccccagcgagaacggcacgaaggaccagugccagauccugcacuucaccgugcccgaggucgaggaggaguucauguacuccugcgacggggacgagcgcccccugcucgugaagggcacccugaucgccaucgacccguucgacgaccggcgcgaggccggcggggagagcaccguggucaaccccaaguccggcagcuggaacuucuucgacugguucuccgggcugaugagcugguucggcggcccccucaagacgauccugcugaucugccucuacguggcccuguccaucgggcuguucuuccuccugaucuaccugggccggaccgggcucagcaagauguggcuggcggccaccaagaaggccagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17329 - RNA, 3172 nt, Artificial Sequence
  mRNA product Design1 comprising derived and/or modified sequence from RVFV(ZH-548)__DQ380206.1__Gne_SP-Gn_Gc (opt1)
gggagaaagcuuaccauggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcucagcgcccacggcaaccccugcaugaaggagaagcuggucaugaagacgcacugccccaacgacuaccaguccgcccacuaccugaacaacgacggcaagauggcgagcgugaagugcccgcccaaguacgagcucaccgaggacugcaacuucugccggcagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacgcugaaguacccggggaucagccaguccagcggcggggacaucggcguccacauggcccacgacgaccaguccgugagcuccaagaucguggcccacugcccgccccaggaccccugccugguccacgacugcaucgugugcgcccacggccucaucaacuaccagugccacaccgcgauggccgggaucgccaugaccgugcugcccgcccuggccgucuucgcgcucgcccccgugguguucgccgaggacugcagcgagcugauccaggccuccagccggaucaccacgugcuccaccgagggcgucaacaccaagugccgccugagcgggaccgcccucauccgggcgggcagcgugggggccgaggccugccugaugcugaagggcgugaaggaggaccagacgaaguuccucaagaucaagaccgucuccagcgagcuguccugccgcgagggccagagcuacuggaccggguccuucagccccaagugccuguccagccggcgcugccaccucgugggcgagugccacgugaaccggugccuguccuggcgcgacaacgagaccagcgccgaguucuccuucgucggggagagcacgaccaugcgggagaacaagugcuucgagcagugcggcggcugggggugcggcugcuucaacgugaaccccuccugccuguucgugcacaccuaccuccagagcguccgcaaggaggcccugcggguguucaacugcaucgacugggugcacaagcugacccucgagaucacggacuucgacggguccgucagcaccaucgaccugggcgcguccagcagccgcuucaccaacuggggguccgugagccugucccuggacgccgagggcaucagcggcuccaacagcuucuccuucaucgagagcccggggaagggcuacgccaucguggacgagcccuucuccgagaucccccggcagggguuccucggcgagauccgcugcaacagcgaguccagcguccuguccgcccacgagagcugccugcgcgcgccgaaccucaucuccuacaagcccaugaucgaccagcuggagugcaccaccaaccugaucgaccccuucgugguguucgagcgggggagccucccccagacgcgcaacgacaagaccuucgccgccuccaagggcaaccggggcguccaggccuucagcaagggguccgugcaggccgaccugacccugauguucgacaacuucgagguggacuucgucggcgcggccgugagcugcgacgccgccuuccucaaccugaccgggugcuacagcugcaacgccggcgcgcgcgugugccuguccaucacgagcaccgggaccggcucccucagcgcccacaacaaggacggcucccugcacaucguccugccgagcgagaacgggaccaaggaccagugccagauccuccacuucacggugcccgagguggaggaggaguucauguacuccugcgacggcgacgagcggccccugcuggucaaggggacccucaucgccaucgaccccuucgacgaccgccgggaggccggcggggagagcaccguggugaacccgaaguccggcagcuggaacuucuucgacugguucuccggccugaugagcugguucgggggcccccugaagaccauccuccugaucugccuguacgucgcccucuccaucgggcuguucuuccugcucaucuaccugggccgcacgggccugagcaagauguggcucgcggccaccaagaaggccuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17330 - RNA, 3406 nt, Artificial Sequence
  mRNA product Design1 comprising derived and/or modified sequence from RVFV(ZH-548)__DQ380206.1__IgE-leader_Gn(delSP)-Gc-variant1 (opt1)
gggagaaagcuuaccauggacuggaccuggauccuguuccucguggccgccgcgacccgcguccacagcgaggacccccaccuccggaaccgcccgggcaaggggcacaacuacaucgacggcaugacgcaggaggacgcgaccugcaagcccgugaccuacgccggggccugcuccagcuucgacgugcugcuggagaagggcaaguucccccuguuccaguccuacgcccaccaccggacccugcucgaggccguccacgacacgaucaucgccaaggccgacccgcccagcugcgaccugcuguccgcccacgggaaccccugcaugaaggagaagcucgugaugaagacccacugccccaacgacuaccagagcgcgcacuaccugaacaacgacggcaagauggccuccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagacgaagaugaagggggucugcgaggugggcgugcaggcccugaagaagugcgacgggcagcuguccaccgcccacgaggucgugcccuucgcgguguucaagaacagcaagaaggucuaccucgacaagcuggaccugaagaccgaggagaaccuccugcccgacuccuucgugugcuucgagcacaagggccaguacaagggcaccauggacagcgggcagacgaagcgggagcugaaguccuucgacaucagccagugcccgaagaucggcgggcacggcuccaagaagugcaccggcgacgccgccuucugcagcgccuacgagugcaccgcccaguacgcgaacgccuacugcagccacgccaacggguccggcaucgugcagauccaggucagcgggguguggaagaagccccucugcgugggcuacgagcgcgucguggugaagcgggagcuguccgccaagcccauccagcgcgucgagcccugcaccacgugcaucaccaagugcgagccgcacgggcugguggugcggagcaccggcuucaagaucuccagcgccgucgcgugcgccuccggcgugugcgucaccgggagccagucccccagcacggagaucacccucaaguaccccggcaucucccagagcuccgggggcgacaucggggugcacauggcccacgacgaccagagcguguccagcaagaucgucgcccacugcccgccccaggaccccugccuggugcacgacugcaucgugugcgcccacggccugaucaacuaccagugccacaccgcgcucuccgccuucgucgugguguucgucuucagcuccaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaacccggcccccaucccccggcacgcgcccaucccgcgcuacagcacguaccucaugcugcugcucaucgugagcuacgccuccgccugcagcgagcugauccaggccuccagccggaucacgaccugcuccaccgagggcgugaacaccaagugccgccugagcgggaccgcccucauccgggcgggcuccgucggcgccgaggccugccugaugcugaagggggugaaggaggaccagaccaaguuccucaagaucaagaccgugagcuccgagcugagcugccgcgagggccaguccuacuggacggggagcuucucccccaagugccugagcucccggcgcugccaccuggucggcgagugccacgugaaccgcugccucagcuggcgggacaacgagaccuccgccgaguucagcuucgugggcgagagcaccaccaugcgcgagaacaagugcuucgagcagugcgggggcugggggugcggcugcuucaacgucaaccccuccugccuguucgugcacacguaccugcagagcgugcggaaggaggcccuccgcgucuucaacugcaucgacugggugcacaagcugacccuggagaucaccgacuucgacggguccgugagcaccaucgaccucggcgcguccagcucccgguucaccaacuggggcagcgucucccugagccuggacgccgaggggaucuccggcagcaacuccuucagcuucaucgaguccccggggaagggcuacgccaucguggacgagcccuucagcgagaucccccgccagggguuccucggcgagauccggugcaacuccgagagcuccgugcugagcgcccacgagagcugccugcgcgcgcccaaccucaucuccuacaagccgaugaucgaccagcuggagugcacgaccaaccugaucgaccccuucgucguguucgagcggggcagccucccccagacccgcaacgacaagaccuucgccgccuccaaggggaaccggggcgugcaggccuucagcaagggguccguccaggccgaccugacgcugauguucgacaacuucgagguggacuucgugggcgcggccgucagcugcgacgccgccuuccucaaccugaccgggugcuacuccugcaacgccggcgcgcgcgugugccugagcaucaccuccaccggcacggggagccucuccgcccacaacaaggacggcagccugcacaucgugcugcccuccgagaacgggaccaaggaccagugccagauccuccacuucaccgucccggagguggaggaggaguucauguacagcugcgacggcgacgagcggccccugcuggugaaggggacccucaucgccaucgaccccuucgacgaccgccgggaggccggcggcgaguccacggucgugaaccccaagagcggguccuggaacuucuucgacugguucagcggccugauguccugguucgggggcccgcugaagaccauccuccugaucugccuguacguggcccucagcaucggccuguucuuccugcucaucuaccuggggcgcaccggccugagcaagauguggcucgcggccaccaagaaggccuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17331 - RNA, 3400 nt, Artificial Sequence
  mRNA product Design1 comprising derived and/or modified sequence from RVFV(ZH-548)__DQ380206.1__IgE-leader_Gn(delSP)-Gc-variant2 (opt1)
gggagaaagcuuaccauggacuggaccuggauccuguuccucguggccgccgcgacccgcguccacagcccccaccuccggaaccgcccgggcaaggggcacaacuacaucgacggcaugacgcaggaggacgcgaccugcaagcccgugaccuacgccggggccugcuccagcuucgacgugcugcuggagaagggcaaguucccccuguuccaguccuacgcccaccaccggacccugcucgaggccguccacgacacgaucaucgccaaggccgacccgcccagcugcgaccugcuguccgcccacgggaaccccugcaugaaggagaagcucgugaugaagacccacugccccaacgacuaccagagcgcgcacuaccugaacaacgacggcaagauggccuccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagacgaagaugaagggggucugcgaggugggcgugcaggcccugaagaagugcgacgggcagcuguccaccgcccacgaggucgugcccuucgcgguguucaagaacagcaagaaggucuaccucgacaagcuggaccugaagaccgaggagaaccuccugcccgacuccuucgugugcuucgagcacaagggccaguacaagggcaccauggacagcgggcagacgaagcgggagcugaaguccuucgacaucagccagugcccgaagaucggcgggcacggcuccaagaagugcaccggcgacgccgccuucugcagcgccuacgagugcaccgcccaguacgcgaacgccuacugcagccacgccaacggguccggcaucgugcagauccaggucagcgggguguggaagaagccccucugcgugggcuacgagcgcgucguggugaagcgggagcuguccgccaagcccauccagcgcgucgagcccugcaccacgugcaucaccaagugcgagccgcacgggcugguggugcggagcaccggcuucaagaucuccagcgccgucgcgugcgccuccggcgugugcgucaccgggagccagucccccagcacggagaucacccucaaguaccccggcaucucccagagcuccgggggcgacaucggggugcacauggcccacgacgaccagagcguguccagcaagaucgucgcccacugcccgccccaggaccccugccuggugcacgacugcaucgugugcgcccacggccugaucaacuaccagugccacaccgcgcucuccgccuucgucgugguguucgucuucagcuccaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaacccggcccccaucccccggcacgcgcccaucccgcgcuacagcacguaccucaugcugcugcucaucgugagcuacgccuccgccugcagcgagcugauccaggccuccagccggaucacgaccugcuccaccgagggcgugaacaccaagugccgccugagcgggaccgcccucauccgggcgggcuccgucggcgccgaggccugccugaugcugaagggggugaaggaggaccagaccaaguuccucaagaucaagaccgugagcuccgagcugagcugccgcgagggccaguccuacuggacggggagcuucucccccaagugccugagcucccggcgcugccaccuggucggcgagugccacgugaaccgcugccucagcuggcgggacaacgagaccuccgccgaguucagcuucgugggcgagagcaccaccaugcgcgagaacaagugcuucgagcagugcgggggcugggggugcggcugcuucaacgucaaccccuccugccuguucgugcacacguaccugcagagcgugcggaaggaggcccuccgcgucuucaacugcaucgacugggugcacaagcugacccuggagaucaccgacuucgacggguccgugagcaccaucgaccucggcgcguccagcucccgguucaccaacuggggcagcgucucccugagccuggacgccgaggggaucuccggcagcaacuccuucagcuucaucgaguccccggggaagggcuacgccaucguggacgagcccuucagcgagaucccccgccagggguuccucggcgagauccggugcaacuccgagagcuccgugcugagcgcccacgagagcugccugcgcgcgcccaaccucaucuccuacaagccgaugaucgaccagcuggagugcacgaccaaccugaucgaccccuucgucguguucgagcggggcagccucccccagacccgcaacgacaagaccuucgccgccuccaaggggaaccggggcgugcaggccuucagcaagggguccguccaggccgaccugacgcugauguucgacaacuucgagguggacuucgugggcgcggccgucagcugcgacgccgccuuccucaaccugaccgggugcuacuccugcaacgccggcgcgcgcgugugccugagcaucaccuccaccggcacggggagccucuccgcccacaacaaggacggcagccugcacaucgugcugcccuccgagaacgggaccaaggaccagugccagauccuccacuucaccgucccggagguggaggaggaguucauguacagcugcgacggcgacgagcggccccugcuggugaaggggacccucaucgccaucgaccccuucgacgaccgccgggaggccggcggcgaguccacggucgugaaccccaagagcggguccuggaacuucuucgacugguucagcggccugauguccugguucgggggcccgcugaagaccauccuccugaucugccuguacguggcccucagcaucggccuguucuuccugcucaucuaccuggggcgcaccggccugagcaagauguggcucgcggccaccaagaaggccuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17332 - RNA, 1885 nt, Artificial Sequence
  mRNA product Design1 comprising derived and/or modified sequence from RVFV(ZH-548)__DQ380206.1__IgE-leader_Gn(delSP)-variant1 (opt1)
gggagaaagcuuaccauggacuggaccuggauccuguuccucguggccgccgcgacccgcguccacagcgaggacccccaccuccggaaccgcccgggcaaggggcacaacuacaucgacggcaugacgcaggaggacgcgaccugcaagcccgugaccuacgccggggccugcuccagcuucgacgugcugcuggagaagggcaaguucccccuguuccaguccuacgcccaccaccggacccugcucgaggccguccacgacacgaucaucgccaaggccgacccgcccagcugcgaccugcuguccgcccacgggaaccccugcaugaaggagaagcucgugaugaagacccacugccccaacgacuaccagagcgcgcacuaccugaacaacgacggcaagauggccuccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagacgaagaugaagggggucugcgaggugggcgugcaggcccugaagaagugcgacgggcagcuguccaccgcccacgaggucgugcccuucgcgguguucaagaacagcaagaaggucuaccucgacaagcuggaccugaagaccgaggagaaccuccugcccgacuccuucgugugcuucgagcacaagggccaguacaagggcaccauggacagcgggcagacgaagcgggagcugaaguccuucgacaucagccagugcccgaagaucggcgggcacggcuccaagaagugcaccggcgacgccgccuucugcagcgccuacgagugcaccgcccaguacgcgaacgccuacugcagccacgccaacggguccggcaucgugcagauccaggucagcgggguguggaagaagccccucugcgugggcuacgagcgcgucguggugaagcgggagcuguccgccaagcccauccagcgcgucgagcccugcaccacgugcaucaccaagugcgagccgcacgggcugguggugcggagcaccggcuucaagaucuccagcgccgucgcgugcgccuccggcgugugcgucaccgggagccagucccccagcacggagaucacccucaaguaccccggcaucucccagagcuccgggggcgacaucggggugcacauggcccacgacgaccagagcguguccagcaagaucgucgcccacugcccgccccaggaccccugccuggugcacgacugcaucgugugcgcccacggccugaucaacuaccagugccacaccgcgcucuccgccuucgucgugguguucgucuucagcuccaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaacccggcccccaucccccggcacgcgcccaucccgcgcuacagcacguaccucaugcugcugcucaucgugagcuacgccuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17333 - RNA, 1879 nt, Artificial Sequence
  mRNA product Design1 comprising derived and/or modified sequence from RVFV(ZH-548)__DQ380206.1__IgE-leader_Gn(delSP)-variant2 (opt1)
gggagaaagcuuaccauggacuggaccuggauccuguuccucguggccgccgcgacccgcguccacagcccccaccuccggaaccgcccgggcaaggggcacaacuacaucgacggcaugacgcaggaggacgcgaccugcaagcccgugaccuacgccggggccugcuccagcuucgacgugcugcuggagaagggcaaguucccccuguuccaguccuacgcccaccaccggacccugcucgaggccguccacgacacgaucaucgccaaggccgacccgcccagcugcgaccugcuguccgcccacgggaaccccugcaugaaggagaagcucgugaugaagacccacugccccaacgacuaccagagcgcgcacuaccugaacaacgacggcaagauggccuccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagacgaagaugaagggggucugcgaggugggcgugcaggcccugaagaagugcgacgggcagcuguccaccgcccacgaggucgugcccuucgcgguguucaagaacagcaagaaggucuaccucgacaagcuggaccugaagaccgaggagaaccuccugcccgacuccuucgugugcuucgagcacaagggccaguacaagggcaccauggacagcgggcagacgaagcgggagcugaaguccuucgacaucagccagugcccgaagaucggcgggcacggcuccaagaagugcaccggcgacgccgccuucugcagcgccuacgagugcaccgcccaguacgcgaacgccuacugcagccacgccaacggguccggcaucgugcagauccaggucagcgggguguggaagaagccccucugcgugggcuacgagcgcgucguggugaagcgggagcuguccgccaagcccauccagcgcgucgagcccugcaccacgugcaucaccaagugcgagccgcacgggcugguggugcggagcaccggcuucaagaucuccagcgccgucgcgugcgccuccggcgugugcgucaccgggagccagucccccagcacggagaucacccucaaguaccccggcaucucccagagcuccgggggcgacaucggggugcacauggcccacgacgaccagagcguguccagcaagaucgucgcccacugcccgccccaggaccccugccuggugcacgacugcaucgugugcgcccacggccugaucaacuaccagugccacaccgcgcucuccgccuucgucgugguguucgucuucagcuccaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaacccggcccccaucccccggcacgcgcccaucccgcgcuacagcacguaccucaugcugcugcucaucgugagcuacgccuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17334 - RNA, 1795 nt, Artificial Sequence
  mRNA product Design1 comprising derived and/or modified sequence from RVFV(ZH-548)__DQ380206.1__IgE-leader_Gc (opt1)
gggagaaagcuuaccauggacuggaccuggauccuguuccucguggccgccgcgacccgcguccacagcugcuccgagcugauccaggccagcucccggaucacgaccugcagcaccgagggcgugaacaccaagugccgccuguccgggacggcccucauccgggccggcagcgugggggccgaggcgugccugaugcugaagggcgucaaggaggaccagaccaaguuccucaagaucaagaccguguccagcgagcuguccugccgcgaggggcagagcuacuggaccggcuccuucagccccaagugccuguccagccggcgcugccaccucgugggcgagugccacgucaaccggugccuguccuggcgcgacaacgagacgagcgccgaguucuccuucgugggggagagcaccaccaugcgggagaacaagugcuucgagcagugcggcggguggggcugcgggugcuucaacgugaacccguccugccuguucguccacaccuaccuccagagcgugcgcaaggaggcccugcggguguucaacugcaucgacuggguccacaagcugacgcucgagaucaccgacuucgacggcagcguguccaccaucgaccugggcgccagcuccagccgcuucaccaacuggggguccgugagccugucccucgacgcggagggcaucagcggguccaacagcuucuccuucaucgagagccccggcaagggcuacgccaucgucgacgagcccuucuccgagaucccccggcagggguuccugggcgagauccgcugcaacagcgaguccagcgugcuguccgcccacgagagcugccuccgggccccgaaccugaucuccuacaagcccaugaucgaccagcuggagugcacgaccaaccucaucgaccccuucguggucuucgagcgcgggagccugccccagacccggaacgacaagaccuucgccgcgagcaagggcaaccgcggggugcaggccuucuccaagggcagcgugcaggccgaccugacgcucauguucgacaacuucgaggucgacuucgugggcgccgccguguccugcgacgcggccuuccugaaccugaccgggugcuacagcugcaacgccggcgcccgggucugccucuccaucaccagcaccgggacgggcucccugagcgcccacaacaaggacgggucccugcacaucgugcucccgagcgagaacggcaccaaggaccagugccagauccugcacuucaccguccccgagguggaggaggaguucauguacuccugcgacggcgacgagcgcccccugcucgugaaggggacccugaucgcgaucgaccccuucgacgaccggcgcgaggccggcggggagagcacggucgugaacccgaaguccggcagcuggaacuucuucgacugguucuccgggcugaugagcugguucggcggcccccucaagaccauccugcugaucugccucuacguggcccuguccaucgggcuguucuuccuccugaucuaccugggccgcaccgggcucagcaagauguggcuggccgccaccaagaaggcgagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17335 - RNA, 955 nt, Artificial Sequence
  mRNA product Design1 comprising derived and/or modified sequence from RVFV(ZH-548)__DQ380151.1__N (opt5)
gggagaaagcuuaccauggacaacuaccaagagcuggccauccaauucgcugcccaggcgguggauagaaaugaaauugagcaguggguccgggaauuugcuuaucagggcuucgacgcccgcagaguuaucgagcuccugaagcaauacgggggagccgauugggaaaaagacgcuaagaaaaugauugugcuugcccugacccggggcaacaagccccgcagaaugaugaugaaaaugagcaaggaggggaaggcuacaguggaggcccucaucaauaaauauaagcugaaagaaggaaacccuucccgggaugagcuuacgcugucucgcgucgcggccgcucucgccggcuggaccugccaggcucuggugguucugagcgaauggcucccggugacagggaccacaauggacggacugucccccgccuacccuagacacaugaugcaucccucuuuugcgggcauggucgauccuagccuucccggcgacuaucugcgggccauucucgaugcucacucccuguaccuucugcaguucucucgcgugaucaauccuaaccucagagggcggaccaaggaggagguugccgcuacauuuacccagccgaugaaugccgccgugaacagcaauuucaucucccaugaaaaacgcagagaguuucugaaggcuuucggacuggucgacagcaacggcaagcccucugcggccgugauggcugccgcccaggcuuauaaaacggccgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17336 - RNA, 3811 nt, Artificial Sequence
  mRNA product Design1 comprising derived and/or modified sequence from RVFV(ZH-548)__DQ380206.1__GP (opt5)
gggagaaagcuuaccauguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccuguccgcucacgggaauccuugcaugaaggagaagcuggugaugaaaacccauugucccaacgauuaucagagcgcccacuaccucaauaacgacggaaagauggccucugucaaaugcccgccuaaguaugaacugacagaggacuguaauuucugccgccaaaugaccggcgcuucccuuaaaaaggggagcuacccccugcaggaucucuuuugccaguccucugaagacgauggaagcaaacugaagacgaagaugaaaggcguuugugaggugggcgugcaggcgcuuaagaaaugcgacgggcaacuguccacagcccaugaagucgugccuuucgcuguuuuuaagaacagcaaaaagguguaccucgauaagcuggaccugaaaaccgaggagaaucuccugcccgauucuuucgucuguuuugaacacaagggacaguauaaaggcacaauggacuccgggcagaccaagagagagcuuaaaucuuucgauauuucucagugccccaagaucggaggccacgggagcaagaaauguaccggagacgccgccuuuugcuccgcuuacgaauguacagcccaauaugcgaacgcuuacugcucucaugccaauggcagcggcauugugcagauccagguuuccgggguguggaagaaaccucugugugucggauaugagcggguggucgugaagcgcgaacucagcgccaaaccgauucaaagaguugagcccugcacgaccuguaucacaaagugcgagccucacggccuggugguccggucuaccggguucaagaucuccagcgcuguggccugcgcuucuggaguuugugugacaggcucccagagccccuccaccgaaauuacgcuuaaauacccugggaucucucagagcuccggcggagauauuggcguccauauggcccacgacgaccagucugugagcuccaagaucguggcgcauugucccccgcaagauccuugccugguucacgacugcauugucugugcccacgggcucaucaacuaucagugccauacagcucugagcgccuucgugguggucuuuguguucucuuccaucgcuauuaucugucuggccauucucuacagaguucugaaaugccuuaagaucgcgccccgcaaagugcugaauccucucauguggauuaccgccuuuauccgguggauuuacaagaaaauggucgcuagaguggccgauaacaucaaccagguuaaucgcgagaucggauggauggaaggcgggcagcuggugcugggaaaccccgcuccuauuccccggcacgccccgaucccuagauauagcaccuaccuuaugcuccugcugauugucucuuaugccuccgcuuguagcgagcucauccaagcgucuagccgcauuacaaccugcuccacagagggcgugaauacgaagugucggcugagcgggaccgcccuuaucagagcuggcucuguuggagccgaagccugccugaugcucaagggcgugaaagaggaccagacaaaguuccugaaaaucaagaccgucuccagcgaacuguccugccgcgaggggcagucuuacuggacaggcagcuuuucccccaaaugucuuucuagccggagaugccaucucgugggagaaugucacgugaaccgcugccuguccuggcgggauaaugagaccucugcugaguucagcuuugucggggaauccacgaccaugagagagaacaaguguuucgaacagugcggaggcuggggguguggcugcuuuaauguuaaccccagcugucuguucgugcacacauaucuccaaucugugcggaaggaggcccugcgcgucuuuaauugcauugacugggugcauaaacuuacccuggaaaucacagauuucgacggauccguuagcaccauugaucucggcgcgucuuccagcagauuuacgaacugggggucugugucccugagccuggacgcugagggaaucuccggcagcaauucuuucagcuucauugaguccccugggaagggauacgccaucgucgaugaaccguuuucugagaucccccggcagggcuuccuuggggaaauuagauguaacagcgaguccucugugcucagcgcccacgaauccugccugcgcgcuccuaaucugaucucuuauaaacccaugauugaccagcucgagugcacaaccaaccugaucgauccuuuuguuguguucgagcggggcagccuuccccagacaagaaaugacaagaccuuugccgcguccaaaggaaaccgcggcguccaggcuuucagcaaggggucugugcaagccgaccugacccucauguuugauaacuucgaaguugacuuugugggagccgcugucuccugugaugccgcuuuccugaaucugacaggcugcuacagcuguaacgccggggcgagagugugccuuucuauuacguccaccggaacaggcagccucuccgcccauaauaaggacggcucucugcacaucgugcugccuagcgagaacgggaccaaagaucagugucaaauccuccauuuuacaguccccgaaguugaggaggaguucauguacuccugcgacggagaugagcggccgcugcuugugaagggcacccugauugcuaucgacccuuuugaugaccgcagagaagccgggggagagagcacgguggucaaucccaaaucuggcuccuggaacuucuucgauugguuuagcgggcucaugucuugguucggaggcccucugaagacaauucugcuuaucugucuguauguggcucucagcauuggccuguuuuuccuccugaucuaccuugggcggaccggacuguccaaaauguggcucgccgccaccaagaaggcuucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17337 - RNA, 3421 nt, Artificial Sequence
  mRNA product Design1 comprising derived and/or modified sequence from RVFV(ZH-548)__DQ380206.1__Gn-Gc (opt5)
gggagaaagcuuaccauggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccuguccgcccauggcaacccuuguaugaaagagaagcugguuaugaagacacacugcccgaaugauuaucagucugcucacuaccucaacaaugacgggaaaauggccagcgugaagugucccccuaaauaugaacugaccgaggauugcaacuuuuguagacagaugacaggagcgucccuuaagaaaggcucuuacccccugcaggaccucuucugccaaagcuccgaggaugacggcagcaagcugaagaccaaaaugaagggggucugugaagugggaguucaggcccuuaaaaagugcgauggccagcugucuacggcucaugagguggucccuuuugccguguucaaaaauuccaagaaaguguaucucgacaagcuggaccugaagaccgaagagaaccuccugcccgauagcuuugucuguuucgagcacaaagggcaguacaagggaacaauggacucuggccaaaccaaacgggaacuuaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucagauccaagugucuggcguguggaaaaagccucugugcgucggguaugaacgcgugguugugaaaagagagcucagcgccaagcccauucagcgggucgaaccuuguacgacaugcaucaccaaaugugagccccacggacuggugguucgcuccacaggcuuuaagauuagcucugccguggcuugcgccuccggggucugugugaccggaagccagucucccagcaccgagaucacacuuaaguacccuggcauuucccaaucuagcggcggggauaucggaguccauauggcgcacgacgaucaguccgugagcucuaaaauuguugcucauugcccgccccaggacccuugucuggugcacgauugcaucgucugcgcccauggccucaucaauuaucagugucacacggcccuguccgcuuucgugguuguguucgucuuuagcucuauugccaucauuugccuggcuauccucuacagagugcugaagugucuuaaaauugcgccccggaaggugcugaacccucucauguggaucaccgccuucauccgcuggauuuauaaaaagaugguugccagagucgcugacaauaucaaccaagugaaucgggaaauuggguggauggagggaggccagcuggugcuugggaaccccgccccgaucccucgccacgcucccauuccuagauacuccacauaccugaugcuccugcugaucgucagcuaugccuccgcgugcucugaacucauccaggccagcucccggauuaccacauguucuaccgagggcgugaacacgaagugccgccugagcggaacagcucuuaucagagccggcuccguuggggcugaagccugucugaugcucaaaggagugaaggaggaucagaccaaauuucugaagauuaaaaccgucagcucugagcuguccugccgggaaggccaaagcuacuggacagggucuuucucccccaagugucuuagcucuagacgcugccaucucgugggagagugucacguuaaucggugccugagcuggagagacaacgaaaccuccgccgaguuuagcuucgugggcgaaucuacaacgaugcgcgagaauaaaugcuuugagcagugugggggcuggggaugcggcuguuucaacgucaauccuuccugccuguuugugcauaccuaucuccagagcguucggaaggaagcucugagaguguucaacuguaucgacuggguccacaaacuuacacuggagauuaccgauuuugacggguccgugucuacaaucgaucucggagcgagcuccucucgcuucaccaauuggggcagcgugucccugucucuggacgccgaagggauuagcggauccaacagcuuuucuuucaucgagucccccggcaaaggguacgcuaucgucgaugagccguucagcgaaauuccucggcagggcuuucuuggagagaucagaugcaauucugaauccagcguucucucugcccacgaguccugucugcgcgcccccaaccugauuagcuauaagcccaugaucgaccaacucgaaugcacgaccaaucugauugauccuuucgugguguuugagcggggcucccuuccgcagacaagaaacgacaaaaccuucgcugccagcaaggggaaucgcggaguccaggcguuuucuaaaggcagcgugcaggcugaucugacacucauguucgacaacuuugagguugauuucgugggggccgccgucuccugugacgcugccuuucugaaucugaccggaugcuacucuuguaacgcgggcgcucgggugugccuuagcaucacguccacagggaccggcucucucagcgcccauaacaaggauggaucccugcacaucguucugcccucugaaaauggcacaaaggaccaaugccagauucuccauuucaccgugccugaggucgaagaggaauuuauguauagcugugacggggaugagagaccccugcuugugaaaggaacccugaucgccauugacccuuucgaugaccggcgcgaggcuggcggggaauccacaguugugaaccccaagagcggaucuuggaacuuuuucgauugguucuccggccucaugagcugguuuggcgggccucugaaaacgauccugcuuauuugccucuacgucgcccugucuaucggacuguucuuucuccugaucuaccuuggcagaaccgggcuguccaagauguggcucgcugccacaaagaaggcgagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17338 - RNA, 3172 nt, Artificial Sequence
  mRNA product Design1 comprising derived and/or modified sequence from RVFV(ZH-548)__DQ380206.1__Gne_SP-Gn_Gc (opt5)
gggagaaagcuuaccauggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccuguccgcccauggcaacccuuguaugaaagagaagcugguuaugaagacacacugcccgaaugauuaucagucugcucacuaccucaacaaugacgggaaaauggccagcgugaagugucccccuaaauaugaacugaccgaggauugcaacuuuuguagacagaugacaggagcgucccuuaagaaaggcucuuacccccugcaggaccucuucugccaaagcuccgaggaugacggcagcaagcugaagaccaaaaugaagggggucugugaagugggaguucaggcccuuaaaaagugcgauggccagcugucuacggcucaugagguggucccuuuugccguguucaaaaauuccaagaaaguguaucucgacaagcuggaccugaagaccgaagagaaccuccugcccgauagcuuugucuguuucgagcacaaagggcaguacaagggaacaauggacucuggccaaaccaaacgggaacuuaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucagauccaagugucuggcguguggaaaaagccucugugcgucggguaugaacgcgugguugugaaaagagagcucagcgccaagcccauucagcgggucgaaccuuguacgacaugcaucaccaaaugugagccccacggacuggugguucgcuccacaggcuuuaagauuagcucugccguggcuugcgccuccggggucugugugaccggaagccagucucccagcaccgagaucacacuuaaguacccuggcauuucccaaucuagcggcggggauaucggaguccauauggcgcacgacgaucaguccgugagcucuaaaauuguugcucauugcccgccccaggacccuugucuggugcacgauugcaucgucugcgcccauggccucaucaauuaucagugucacacggccauggcugggauugccaugaccgugcugcccgcucuggccguuuucgcgcucgccccuguggucuucgcugaagacugcuccgagcugauccaagccagcucuagaauuacaaccuguuccacagaaggagugaacaccaagugccggcuuagcggcacggcucugauccgcgccggguccgugggcgcggaggccugucucaugcugaaaggaguuaaggaagaucagacaaaauuucuuaagauuaagaccgucucuagcgagcuguccugcagagagggccagucuuacuggaccgggagcuucucccccaaaugucucagcucucggcgcugccaccuggugggagaaugucaugugaauagaugccuguccuggcgggacaacgagacaagcgcugaauuuucuuucgucggcgaguccaccacaaugcgcgaaaauaaguguuuugagcagugcgggggauggggcugcggguguuucaacgugaacccgagcugccucuuuguucacacguaucugcaaucugugagaaaagaggcccuucgggucuucaauuguaucgacugggugcauaagcugacccucgaaaucacagauuuugacggcagcguuuccaccauugaucugggagcuucuagcuccagauucacaaacuggggcagcgugucccugucucuugacgccgaggggaucagcggauccaauucuuuuagcuucauugaauccccuggcaaaggguacgccaucgucgaugagcccuuuucugagauuccucgccagggauuccucggcgaaauccggugcaacagcgaguccagcgugcugucugcucacgaauccugucugagagcgcccaaucucaucagcuacaagccuaugauugaccagcuggagugcaccacgaaccuuaucgaucccuucguuguguuugaacgcgggucucugccgcagacccggaaugacaaaacauucgccgcuuccaagggcaacagaggaguccaagccuuuagcaagggcucugugcaggccgaucucacccugauguucgacaauuuugagguggauuucgucggggcugccguuuccugugacgcggcuuuucugaaccuuacaggaugcuauagcuguaaugccggcgcccgcgugugccucuccauuaccagcacggggacaggaucucugagcgcucacaacaaagauggcucccugcauaucgugcucccuucugagaaugggaccaaggaccagugucagauucugcacuucacaguccccgaaguggaggaagaguuuauguacagcugcgacggcgaugaacggccccuucugguuaaaggaacccucaucgccauugacccuuucgaugacagacgcgaggcgggcggggaguccaccguggucaacccgaagucuggaagcuggaacuuuuucgauugguuuuccggccugaugucuugguucgggggaccccugaaaacaauccuucucaucugccuguauguggcucugagcauuggccucuucuuucugcuuaucuaccugggccggacggggcucuccaagauguggcuggccgccaccaagaaagcuagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17339 - RNA, 3406 nt, Artificial Sequence
  mRNA product Design1 comprising derived and/or modified sequence from RVFV(ZH-548)__DQ380206.1__IgE-leader_Gn(delSP)-Gc-variant1 (opt5)
gggagaaagcuuaccauggacuggaccuggauccuguuccucguggccgcugccacaagaguccacagcgaggauccccaucugcggaaccgcccuggcaaggggcacaauuacauugacggaaugacgcaggaagaugcgaccugcaaaccgguuacauaugcuggcgccuguuccucuuuugacgugcuucuggagaaggggaaauucccccucuuucaaagcuacgcccaucacagaacccugcuugaagcugugcaugauacaaucauugccaaggcugacccucccuccugcgaucugcucucugcccacggaaacccuuguaugaaagagaagcuggucaugaagacccacugccccaaugacuaucagagcgcgcauuaccugaacaaugauggcaaaauggccuccgugaaguguccuccgaaauaugaacucacagaggacugcaacuucugucggcagaugaccggggcuucucugaagaaaggaagcuacccccuucaggaucuguuuugccaauccagcgaggacgauggcucuaagcucaagacgaaaaugaagggcguuugugaaguggggguccaggcccugaaaaagugcgacggacagcuuuccaccgcucacgaggugguuccuuucgccguguuuaaaaauagcaagaaagucuaucuggacaagcucgaucugaagacagaagagaaccugcuccccgacucuuucguguguuuugagcauaaaggccaguacaaggggaccauggauuccggacaaacaaaacgcgaacuuaagagcuucgacaucucucagugcccuaaaauuggcgggcacggauccaagaagugcaccggcgaugcggccuuuuguagcgcuuacgagugcacggcccaguaugcuaaugccuacuguucccacgccaacggcucugggaucgugcagauccaagucagcggaguuuggaaaaagccccugugcgugggcuaugaaagaguggucgugaaacgggagcuguccgcuaagccgauucagcgcguugaaccuuguacaaccugcaucacaaaaugugagccccaugggcucguggucagaagcaccggauucaagauuucuuccgcgguggccugcgcuagcggcguuugugugaccgggucucagagcccuuccacagagaucacgcugaaguaccccggaauuucucaaagcuccggcggcgacaucgggguccacauggcccaugaugaccagagcgugucuuccaaaauugucgcccacugucccccucaggauccgugccuugugcaugacugcaucguuugcgcucacggacugaucaauuaucagugucacaccgcccucagcgcguuuguggucguguucguuuucucuuccauugcuaucauuugccuggccauccuguaccgggugcucaagugucugaaaauugcuccccgcaagguccuuaacccucugauguggaucacagccuuuaucagauggauuuauaaaaagaugguggcccggguggcugauaauaucaaccaaguuaaucgcgaaauuggcuggauggaagggggacagcucguccugggcaaccccgccccuauccccagacaugcgccgauuccucgguacagcaccuaccuuaugcugcuccugaucguguccuaugccucugcuugcagcgaacugauccaggccuccucucgcauuacaaccuguagcacggagggggugaacacaaagugcagacucuccggcaccgcucugauccgggccggaagcgucggcgcggaagccugucuuaugcugaaaggggugaaggaggaccagaccaaauuccucaagauuaaaacaguuucuuccgagcugagcugcagagaaggacaaucuuacuggaccggcuccuuuagccccaagugucugucuagccgccggugccaccuugugggggagugucaugucaauagaugccucuccuggcgcgacaacgaaacaagcgcugaguucucuuuugugggagaauccacgaccaugcgggagaauaaaugcuucgagcaguguggcggguggggcugcggauguuuuaacguuaauccuagcugccuguucgugcacacauaucugcaguccgucagaaaggaagcccuccgcguguuuaacuguaucgauuggguucacaagcugacccuugagauuacagacuucgauggcucugugagcaccaucgaccugggggcuuccucuagccgguuuacgaauuggggauccgucucucucagccuggaugccgaaggcauuuccgggagcaacucuuucuccuuuaucgagagccccggaaaaggcuacgccaucguggacgagccuuucucugaaauucccagacagggguuccugggcgagauccgcugcaauuccgaaagcucugugcuuuccgcucaugagagcugucuccgggcgccgaaccugauuuccuauaagccuaugaucgaucaacuggaaugcaccacaaaucucauugaccccuuugucguuuucgagagaggaagccugccccagacccgcaacgauaaaacauuugccgcuucuaagggcaauagaggggugcaggccuucagcaaaggauccgugcaggccgaccuuacccugauguuugauaacuucgaggucgacuuugugggcgcugccguuucuugugaugcggcuuuccucaaucugacggggugcuacagcuguaacgccggagcccgggugugccuguccaucacaucuaccggcacagggagccuuuccgcucacaacaaggacggcucucuccauaucguccugccuagcgaaaauggaaccaaggaccaaugccagauucugcacuuuaccgugccggagguugaagaggaguucauguauuccugugauggcgacgagcggccccuccuggugaaagggacacuuaucgccauugauccuuuugacgaucgcagagaggcgggaggcgaaagcacggucgugaaccccaagucuggguccuggaauuucuuugacugguucagcggacugaugucuugguucggcggcccucucaaaaccauccugcugauuugccuuuacguugcucucuccaucgggcuguuuuuccugcucaucuaccugggacggacaggccuuagcaagauguggcuggccgccaccaaaaaggcuuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17340 - RNA, 3400 nt, Artificial Sequence
  mRNA product Design1 comprising derived and/or modified sequence from RVFV(ZH-548)__DQ380206.1__IgE-leader_Gn(delSP)-Gc-variant2 (opt5)
gggagaaagcuuaccauggacuggaccuggauccuguuccucguggccgcugccacaagaguccacagcccccaucugcggaaccgcccuggcaaggggcacaauuacauugauggaaugacgcaggaggacgcgaccugcaaaccgguuacauaugcuggcgccuguuccucuuuugaugugcuucuggaaaaggggaaauucccccucuuucaaagcuacgcccaucacagaacccugcuugaggcugugcaugacacaaucauugccaaggcugauccucccuccugcgaccugcucucugcccacggaaacccuuguaugaaagaaaagcuggucaugaagacccacugccccaaugauuaucagagcgcgcauuaccugaacaaugacggcaaaauggccuccgugaaguguccuccgaaauaugagcucacagaagauugcaacuucugucggcagaugaccggggcuucucugaagaaaggaagcuacccccuucaggaccuguuuugccaauccagcgaggaugacggcucuaagcucaagacgaaaaugaagggcguuugugagguggggguccaggcccugaaaaagugcgauggacagcuuuccaccgcucacgaagugguuccuuucgccguguuuaaaaauagcaagaaagucuaucuggacaagcucgaccugaagacagaggaaaaccugcuccccgauucuuucguguguuuugagcauaaaggccaguacaaggggaccauggacuccggacaaacaaaacgcgagcuuaagagcuucgauaucucucagugcccuaaaauuggcgggcacggauccaagaagugcaccggcgacgcggccuuuuguagcgcuuacgaaugcacggcccaguaugcuaaugccuacuguucccacgccaacggcucugggaucgugcagauccaagucagcggaguuuggaaaaagccccugugcgugggcuaugagagaguggucgugaaacgggaacuguccgcuaagccgauucagcgcguugagccuuguacaaccugcaucacaaaaugugaaccccaugggcucguggucagaagcaccggauucaagauuucuuccgcgguggccugcgcuagcggcguuugugugaccgggucucagagcccuuccacagagaucacgcugaaguaccccggaauuucucaaagcuccggcggcgauaucgggguccacauggcccaugacgaucagagcgugucuuccaaaauugucgcccacugucccccucaggacccgugccuugugcaugauugcaucguuugcgcucacggacugaucaauuaucagugucacaccgcccucagcgcguuuguggucguguucguuuucucuuccauugcuaucauuugccuggccauccuguaccgggugcucaagugucugaaaauugcuccccgcaagguccuuaacccucugauguggaucacagccuuuaucagauggauuuauaaaaagaugguggcccggguggcugacaauaucaaccaaguuaaucgcgagauuggcuggauggaagggggacagcucguccugggcaaccccgccccuauccccagacaugcgccgauuccucgguacagcaccuaccuuaugcugcuccugaucguguccuaugccucugcuugcagcgagcugauccaggccuccucucgcauuacaaccuguagcacggaaggggugaacacaaagugcagacucuccggcaccgcucugauccgggccggaagcgucggcgcggaggccugucuuaugcugaaaggggugaaggaagaucagaccaaauuccucaagauuaaaacaguuucuuccgagcugagcugcagagagggacaaucuuacuggaccggcuccuuuagccccaagugucugucuagccgccggugccaccuugugggggaaugucaugucaauagaugccucuccuggcgcgacaacgagacaagcgcugaguucucuuuugugggagaauccacgaccaugcgggaaaauaaaugcuucgagcaguguggcggguggggcugcggauguuuuaacguuaauccuagcugccuguucgugcacacauaucugcaguccgucagaaaggaggcccuccgcguguuuaacuguaucgacuggguucacaagcugacccuugaaauuacagauuucgacggcucugugagcaccaucgaucugggggcuuccucuagccgguuuacgaauuggggauccgucucucucagccuggacgccgagggcauuuccgggagcaacucuuucuccuuuaucgaaagccccggaaaaggcuacgccaucguggaugagccuuucucugagauucccagacagggguuccugggcgaaauccgcugcaauuccgagagcucugugcuuuccgcucaugaaagcugucuccgggcgccgaaccugauuuccuauaagccuaugaucgaccaacuggagugcaccacaaaucucauugaucccuuugucguuuucgaaagaggaagccugccccagacccgcaacgacaaaacauuugccgcuucuaagggcaauagaggggugcaggccuucagcaaaggauccgugcaggccgaucuuacccugauguuugacaacuucgaggucgauuuugugggcgcugccguuucuugugacgcggcuuuccucaaucugacggggugcuacagcuguaacgccggagcccgggugugccuguccaucacaucuaccggcacagggagccuuuccgcucacaacaaggauggcucucuccauaucguccugccuagcgagaauggaaccaaggaccaaugccagauucugcacuuuaccgugccggaaguugaggaagaguucauguauuccugugacggcgaugaacggccccuccuggugaaagggacacuuaucgccauugacccuuuugaugaccgcagagaggcgggaggcgagagcacggucgugaaccccaagucuggguccuggaauuucuuugauugguucagcggacugaugucuugguucggcggcccucucaaaaccauccugcugauuugccuuuacguugcucucuccaucgggcuguuuuuccugcucaucuaccugggacggacaggccuuagcaagauguggcuggccgccaccaaaaaggcuuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17341 - RNA, 1885 nt, Artificial Sequence
  mRNA product Design1 comprising derived and/or modified sequence from RVFV(ZH-548)__DQ380206.1__IgE-leader_Gn(delSP)-variant1 (opt5)
gggagaaagcuuaccauggacuggaccuggauccuguuccucguggccgcugccacaagaguccacagcgaggauccccaucugcggaaccgcccuggcaaggggcacaauuacauugacggaaugacgcaggaggaugcgaccugcaaaccgguuacauaugcuggcgccuguuccucuuuugacgugcuucuggagaaggggaaauucccccucuuucaaagcuacgcccaucacagaacccugcuugaagcugugcaugauacaaucauugccaaggcugacccucccuccugcgaucugcucucugcccacggaaacccuuguaugaaagagaagcuggucaugaagacccacugccccaaugacuaucagagcgcgcauuaccugaacaaugauggcaaaauggccuccgugaaguguccuccgaaauaugaacucacagaggacugcaacuucugucggcagaugaccggggcuucucugaagaaaggaagcuacccccuucaggaucuguuuugccaauccagcgaggacgauggcucuaagcucaagacgaaaaugaagggcguuugugaaguggggguccaggcccugaaaaagugcgacggacagcuuuccaccgcucacgaggugguuccuuucgccguguuuaaaaauagcaagaaagucuaucuggacaagcucgaucugaagacagaagagaaccugcuccccgacucuuucguguguuuugagcauaaaggccaguacaaggggaccauggauuccggacaaacaaaacgcgaacuuaagagcuucgacaucucucagugcccuaaaauuggcgggcacggauccaagaagugcaccggcgaugcggccuuuuguagcgcuuacgagugcacggcccaguaugcuaaugccuacuguucccacgccaacggcucugggaucgugcagauccaagucagcggaguuuggaaaaagccccugugcgugggcuaugaaagaguggucgugaaacgggagcuguccgcuaagccgauucagcgcguugaaccuuguacaaccugcaucacaaaaugugagccccaugggcucguggucagaagcaccggauucaagauuucuuccgcgguggccugcgcuagcggcguuugugugaccgggucucagagcccuuccacagagaucacgcugaaguaccccggaauuucucaaagcuccggcggcgacaucgggguccacauggcccaugaugaccagagcgugucuuccaaaauugucgcccacugucccccucaggauccgugccuugugcaugacugcaucguuugcgcucacggacugaucaauuaucagugucacaccgcccucagcgcguuuguggucguguucguuuucucuuccauugcuaucauuugccuggccauccuguaccgggugcucaagugucugaaaauugcuccccgcaagguccuuaacccucugauguggaucacagccuuuaucagauggauuuauaaaaagaugguggcccggguggcugauaauaucaaccaaguuaaucgcgaaauuggcuggauggaagggggacagcucguccugggcaaccccgccccuauccccagacaugcgccgauuccucgguacagcaccuaccuuaugcugcuccugaucguguccuaugccucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17342 - RNA, 1879 nt, Artificial Sequence
  mRNA product Design1 comprising derived and/or modified sequence from RVFV(ZH-548)__DQ380206.1__IgE-leader_Gn(delSP)-variant2 (opt5)
gggagaaagcuuaccauggacuggaccuggauccuguuccucguggccgcugccacaagaguccacagcccccaucugcggaaccgcccuggcaaggggcacaauuacauugauggaaugacgcaggaggacgcgaccugcaaaccgguuacauaugcuggcgccuguuccucuuuugaugugcuucuggaaaaggggaaauucccccucuuucaaagcuacgcccaucacagaacccugcuugaggcugugcaugacacaaucauugccaaggcugauccucccuccugcgaccugcucucugcccacggaaacccuuguaugaaagaaaagcuggucaugaagacccacugccccaaugauuaucagagcgcgcauuaccugaacaaugacggcaaaauggccuccgugaaguguccuccgaaauaugagcucacagaagauugcaacuucugucggcagaugaccggggcuucucugaagaaaggaagcuacccccuucaggaccuguuuugccaauccagcgaggaugacggcucuaagcucaagacgaaaaugaagggcguuugugagguggggguccaggcccugaaaaagugcgauggacagcuuuccaccgcucacgaagugguuccuuucgccguguuuaaaaauagcaagaaagucuaucuggacaagcucgaccugaagacagaggaaaaccugcuccccgauucuuucguguguuuugagcauaaaggccaguacaaggggaccauggacuccggacaaacaaaacgcgagcuuaagagcuucgauaucucucagugcccuaaaauuggcgggcacggauccaagaagugcaccggcgacgcggccuuuuguagcgcuuacgaaugcacggcccaguaugcuaaugccuacuguucccacgccaacggcucugggaucgugcagauccaagucagcggaguuuggaaaaagccccugugcgugggcuaugagagaguggucgugaaacgggaacuguccgcuaagccgauucagcgcguugagccuuguacaaccugcaucacaaaaugugaaccccaugggcucguggucagaagcaccggauucaagauuucuuccgcgguggccugcgcuagcggcguuugugugaccgggucucagagcccuuccacagagaucacgcugaaguaccccggaauuucucaaagcuccggcggcgauaucgggguccacauggcccaugacgaucagagcgugucuuccaaaauugucgcccacugucccccucaggacccgugccuugugcaugauugcaucguuugcgcucacggacugaucaauuaucagugucacaccgcccucagcgcguuuguggucguguucguuuucucuuccauugcuaucauuugccuggccauccuguaccgggugcucaagugucugaaaauugcuccccgcaagguccuuaacccucugauguggaucacagccuuuaucagauggauuuauaaaaagaugguggcccggguggcugacaauaucaaccaaguuaaucgcgagauuggcuggauggaagggggacagcucguccugggcaaccccgccccuauccccagacaugcgccgauuccucgguacagcaccuaccuuaugcugcuccugaucguguccuaugccucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17343 - RNA, 1795 nt, Artificial Sequence
  mRNA product Design1 comprising derived and/or modified sequence from RVFV(ZH-548)__DQ380206.1__IgE-leader_Gc (opt5)
gggagaaagcuuaccauggacuggacauggauccuguuccucguggccgcugccacaagaguccacagcugcuccgagcugauucaggcgucuagccggaucacgaccuguuccacagaaggcguuaauaccaagugccgccuuucugggacagcucugauuagagccggaagcgugggcgccgaggcuugucucaugcugaaaggggugaaggaagaucaaaccaaauuucuuaagaucaaaacagucuccucugagcugagcugccgggaaggacaguccuacuggaccggcagcuucucucccaagugucucuccagccgcagaugccaucuggugggggagugucacguuaaucggugccugucuuggcgcgacaacgagacguccgccgaauuuagcuucgugggagagucuaccacaaugagagaaaauaaguguuuugagcagugcggcggcuggggguguggaugcuucaacgucaauccuuccugccucuuugugcauaccuaucugcagagcguucggaaagaggcucuccgcguguucaacuguauugauuggguccacaagcugacacucgaaaucaccgacuuugauggcuccgugucuacgaucgaccugggggccagcuccagcagauucacaaauuggggaucugugucccuuagccuggaugcggagggcauuucugggagcaacuccuuuucuuucaucgaaagcccgggaaaaggcuacgccauugucgacgagcccuuuuccgaaaucccucggcaaggcuuccucggggagauucgcugcaauagcgagucuuccguucugagcgcucaugaaucuugucugagagcccccaaccucaucuccuauaagccuaugauugaucagcuggagugcaccacaaaucuuaucgaccccuucgugguguuugaacggggaagccugccucagacccgcaacgauaaaaccuucgcugccuccaagggcaauagagggguccaggcguuuucuaagggaagcgugcaagccgaccucacacugauguucgauaacuuugagguugacuucgugggcgcugccgucuccugugacgcugccuuucuuaaucugacggggugcuacucuuguaacgccggagcucgggugugccucagcaucaccuccacaggcaccggcagccugucugcgcacaacaaagaugggucccugcacauuguucucccgagcgaaaauggaacaaaggaccagugucagauccugcauuucaccgugcccgaggucgaggaagaguuuauguauucuugcgauggcgacgaaagaccucuucuggugaaagggacgcucauugccaucgaucccuucgacgaucgccgggaggcuggaggcgaauccacagucgugaacccuaagagcgggucuuggaacuuuuucgacugguuuagcggccugauguccugguucggaggcccccuuaaaaccauucugcucaucugucuguacguugcccugagcaucgggcuuuucuuucugcuuauuuaucugggaagaaccggccucucuaagauguggcuggccgcuaccaaaaaggccuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17344 - RNA, 955 nt, Artificial Sequence
  mRNA product Design1 comprising derived and/or modified sequence from RVFV(ZH-548)__DQ380151.1__N (opt11)
gggagaaagcuuaccauggacaacuaccaagaacucgcaauccaguucgccgcccaagccgucgaccgcaacgaaaucgaacaauggguccgagaauuugccuaccaaggcuucgacgcccgacgagucaucgaacuccucaaacaauacggaggcgccgacugggaaaaagacgccaagaaaaugaucguacuagcccucacccgaggcaacaaaccccgccgaaugaugaugaaaaugucaaaagaaggcaaagccaccgucgaagcccucaucaacaaauacaaacucaaggaaggcaaccccucccgggacgaacucacacucucccgcguagccgcagcccucgccggcuggaccugccaagcccucgucguccuauccgaauggcuuccagucacaggcacaaccauggacggccucucccccgccuauccccgccacaugaugcaccccucauucgccggcauggucgaccccucacuccccggcgacuaccuacgagccauccuagacgcacacucccucuaccuccuccaauucucccgcgucaucaaccccaaccuacgcggccgcaccaaagaagaaguagccgccaccuucacacaaccaaugaacgccgcagucaacuccaacuucaucucccacgaaaaacgccgcgaauuucucaaagccuucggccuuguagacuccaacggcaaacccuccgccgccgucauggcugccgcacaagcguacaaaaccgccgcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17345 - RNA, 3811 nt, Artificial Sequence
  mRNA product Design1 comprising derived and/or modified sequence from RVFV(ZH-548)__DQ380206.1__GP (opt11)
gggagaaagcuuaccauguacguucugcucaccauacucaucuccguccucgucugugaagcaguuauucgggucucacuaucgagcacucgggaagagacaugcuucggagacuccaccaauccagaaaugauagagggugccugggacucauuacgagaggaagaaaugccagaggaacucucgugcucaauaucgggcauucgggaggucaaaacguccagucaagagcuauaucgcgcacugaaagcaaucauugcagccgacggacucaauaacaucacgugccauggaaaagacccagaggacaaaauaucacuaaucaagggcccaccacacaagaaacgagucggcauaguccgaugcgaacgucgccgcgacgccaaacaaaucggucgagaaaccauggccggaaucgcaaugaccguacuacccgcccucgcgguuuucgcccuagcacccgucgucuucgcggaagacccccaccuccgcaaccggccaggcaaaggucacaacuauauagacggaaugacgcaggaagacgcaacauguaaaccaguaaccuaugccggcgcaugcagcucauuugacguccuccucgagaaaggcaaguucccgcuauuccaaagcuacgcucaccaccgcacccuccuggaggccguacacgacacaauaaucgcgaaagcggacccacccaguugcgaucuacuaucggcccacggaaaucccuguaugaaagaaaagcuaguuaugaaaacccauugccccaacgacuaccagagcgcccacuaccucaacaaugaugggaaaauggccucagucaaaugcccgcccaaauacgaacuaaccgaggacugcaacuucugccgccaaaugaccggagccucacuaaagaaaggcucuuacccccuccaagaccucuuuugccaaucguccgaggacgauggcucaaaacuuaaaacaaaaaugaaaggugucugcgaagucggagugcaagcccugaagaaaugugacggacaacucuccacagcccacgaaguaguacccuucgccguauucaaaaacucaaagaaaguauaccuggacaaacuggaccuuaaaacagaggaaaaccugcugcccgacuccuuugugugcuucgaacacaaaggccaauacaaaggcacuauggacagcggacagaccaaacgggaacuaaagagcuucgacaucucccaaugucccaaaauuggcggccacggauccaagaaauguacaggggacgccgccuucugcucagccuacgaaugcaccgcgcaauacgcuaacgcguacugcucccaugccaacggguccggcaucguccagauccaagucuccggcguguggaagaaaccucucuguguaggcuaugaacgcgucguagucaaaagagaacucucugcuaaacccauccaacggguggaaccaugcaccacgugcauaacaaaaugcgagccacacggccucguuguucgauccacaggcuuuaaaaucucaagcgcuguagccugcgcauccggcgucugcgucaccgguucucaguccccaucaacagagaucacacugaaauaccccggcauaucccaaucaucgggcggcgacauaggaguucacauggcucacgacgaccagagcguauccuccaaaaucgucgcccacugcccaccccaggaccccugccucguucaugacugcaucgucugugcacacggccucauaaacuaccaaugccacaccgcccuauccgccuuugucgugguauucguauucagcagcaucgcaaucauaugccuugcaauccuguaccgcguccugaaaugccuuaaaauugccccacgcaaaguccucaacccacugauguggaucacugccuucauacgcuggauauacaagaaaauggucgcccgcguagccgacaacaucaaccaaguaaaccgagagauaggcuggauggagggcggccaacucguccuuggcaacccagccccaauacccaggcacgcaccgauuccucgguauuccacauaccucaugcuccuucugaucgucagcuacgcaucggccugcuccgaacucauacaggcauccagcagaauuacaaccuguucaaccgagggcgucaacacgaaaugucgucuguccgguaccgcacuaauacgcgcugguucaguaggagcggaggccugucuuaugcuuaaaggcguaaaagaggaucaaaccaaauuccugaaaaucaaaacagugagcucggaacucucaugccgcgaaggacaauccuacuggacaggaucguucucaccaaaaugccuaucuagcagacgaugccaccucgucggggagugccaugugaaucgcugccucuccuggcgagacaacgagacaagcgccgaguucucuuucguaggggaaagcaccaccaugagagaaaacaaaugcuucgaacagugcggcggauggggaugcggcugcuuuaacgucaaccccucgugccuguuuguacauacuuaccuccaaucaguacgcaaagaagcauugcgcguuuucaauugcaucgacuggguccacaaacucacccuagaaaucacagacuucgacggcuccgucucgaccaucgaccugggcgccagcuccucaagguucacgaacuggggcuccguaucccucucccuugacgcggaaggaaucuccggcagcaacucguucucauucaucgaaucacccggaaaaggcuacgccaucgucgacgaacccuucuccgaaauaccgagacaaggauuccucggagaaaucagaugcaacucagagagcuccgugcugucugcccacgaaaguugccucagagcacccaaccucaucagcuacaaaccaaugaucgaucaacuagaaugcacuacuaaccuaauagaccccuuugucguuuucgaacgcggcucccucccacaaaccaggaacgacaaaaccuuugcagcuaguaaaggaaacagaggaguccaagcguucucaaaaggcucaguccaagcagaucuaacccucauguucgacaacuucgagguugacuucgugggcgccgcagucuccugugacgcagcguucuugaaccucacaggcugcuacucuugcaacgccggagcaagaguuugccucucaaucacgagcacaggaacgggaucccuaucagcccacaacaaagacggcagccuucacaucguacucccgucugagaacggaaccaaagaucaaugucaaauccuacacuucaccguacccgaagucgaagaagaguucauguacucuugcgacggcgacgaacgaccacuacucgucaaagggacccucaucgcaauugacccauucgaugaucgccgcgaagcuggaggcgagagcacagucgucaaccccaaaagcggcuccuggaacuuuuucgacugguucagcggacucauguccugguuugguggcccacucaaaacaauccuccucaucugccucuacguagcccugagcaucggccucuucuuccuccuuaucuaccuagggcgaacagggcuuucgaaaauguggcuugcugccaccaagaaagccuccuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17346 - RNA, 3421 nt, Artificial Sequence
  mRNA product Design1 comprising derived and/or modified sequence from RVFV(ZH-548)__DQ380206.1__Gn-Gc (opt11)
gggagaaagcuuaccauggcaggaauagcaaugacgguucugccagcgcuagccguuuucgcacuagcaccagucgucuucgcggaagacccccaucuacgcaaccgacccggaaaaggacacaacuacaucgacggaaugacacaagaagaugcaacaugcaaaccagucacauacgcaggcgccugcuccuccuucgacguccuacuugagaaagguaaauucccccucuuucaaagcuacgcgcaccaccguacccuccucgaagcaguccacgacacaaucauagcaaaggcugacccacccagcugugaccuccucuccgcccauggcaaccccugcaugaaggaaaaacucguaaugaaaacacacugcccgaacgacuaccaauccgcccacuaccucaacaacgacggaaagauggccucuguuaagugcccaccaaaauacgagcugaccgaagacugcaacuuuugccgucaaaugaccggagccucccucaagaaagggucauacccacuccaagaucuauuuugccaaagcuccgaggacgacggcagcaaauuaaaaaccaagaugaaagguguaugcgaagugggcguccaggcccucaagaaaugcgacggccaacuuuccacugcacacgaagugguacccuucgccguguucaaaaacuccaagaaagucuauuuagacaaacucgaccuaaaaacggaagagaaccuccuacccgacucauuugucugcuuugagcacaaaggccaauacaaaggaacaauggauagcgggcaaacaaaaagggaacucaaguccuucgacaucagccagugccccaaaaucggcggacaugggagcaaaaagugcaccggcgacgcugcauucugcagugccuacgagugcaccgcgcaauacgcuaacgcauacugcagucaugcuaacggcagcggaauuguacaaauccaggucuccggcguguggaagaaaccacuaugcguaggcuacgaacggguugucgucaaaagagagcuuuccgccaaacccauucaacgaguugaaccaugcacuacauguaucaccaaaugugaaccucauggucuaguuguccgcucgaccggauucaagaucucgagcgccguagccugcgccuccggagugugcgucacaggcucacaaucccccucgacagaaauuacccugaaauacccuggaaucucccaguccucgggaggcgacauagggguacacauggcccacgacgaccaaagcgucuccuccaaaauaguagcucacugcccaccacaggaccccugucucguacacgacugcauaguaugugcacauggucucaucaacuaccaaugccacacagcacucagugcauuuguaguuguauucguauucuccucuaucgccaucaucugccuagccauacucuacaggguccucaaaugccuaaaaaucgcaccacgaaaaguccucaacccccuaauguggauaaccgccuucauccgcuggauauacaagaaaauggucgcccgcgucgcagacaacaucaaucaagucaaccgugaaaucggcuggauggaaggaggacaacugguccuuggaaacccagcgccaauaccccgccacgccccaauuccucgauacuccaccuaccuaaugcuucuccuaaucguauccuacgccuccgccugcagcgaacucauacaggcuuccucacgcauaacuacgugcuccaccgaaggaguuaacaccaaaugccgacucucagggacagcccuaaucagagcgggaaguguaggcgcagaagccugccuuaugcugaaaggagucaaagaggaccaaacaaaauuccuaaagaucaaaaccgucucaucugagcucagcugccgcgaaggacaauccuacuggacagguuccuucucccccaaaugccugucaucccgcagaugccauuuagucggcgagugccauguaaaccgaugccucuccuggcgcgacaacgagacuucagcggaguucagcuucguaggggaaucuacaaccaugcgugagaacaagugcuucgaacaaugcggaggcuggggaugcgguugcuucaacgucaacccauccugccuauucguacauacuuaccuccaguccgucagaaaagaggcgcuacgcgucuucaacuguauagacuggguucacaaacuuacccuggaaauaaccgacuucgacggauccgucagcacaauagaucugggagcuuccagcucacguuucacgaacuggggguccgucucgcuuucucuagacgccgaaggcauaagcggcuccaacuccuucuccuucaucgaaagccccggcaaaggcuacgccaucguagacgagccauucucagagaucccccgccaaggcuuccucggcgagaucagauguaacagcgaauccuccguacucucagcacacgaauccugccuucgcgcaccaaaucuuaucuccuacaaacccaugaucgaccaacuagaauguaccaccaaucuaauagaucccuucguaguauucgaacgcggcucucuaccccaaacacgcaacgacaaaacauucgcggccuccaaagggaaccggggcgugcaagccuucuccaaaggaaguguccaagccgaucucacacucauguucgacaacuuugaaguagacuucgucggggcggccguaaguugcgaugcggccuuccuaaaccugaccggcuguuacucaugcaacgcgggcgccagagucugccucuccauaaccuccaccggaaccggaucacugucagcacacaacaaagacggaucccuacacaucguccuuccauccgaaaauggcacaaaagaccaaugccaaaucuuacacuucaccgucccagaaguagaagaagaguucauguacaguugcgacggagaugagcgcccguuacucguaaagggcacacuuauagccauugacccguucgacgacagacgugaggccggaggagaaagcaccgucguaaauccaaagucagggucauggaacuucuucgacugguuuuccggauuaauguccugguucggaggcccucucaaaacuauacuccuaauaugccuauacgucgcccucuccaucggccuauucuuccuccuaauauaccucggacgcacaggccucuccaaaauguggcuagccgccaccaaaaaggccuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17347 - RNA, 3172 nt, Artificial Sequence
  mRNA product Design1 comprising derived and/or modified sequence from RVFV(ZH-548)__DQ380206.1__Gne_SP-Gn_Gc (opt11)
gggagaaagcuuaccauggcaggaaucgccaugacaguccuaccagcacuugccguauuugcccucgccccaguaguauuugccgaagacccacaccucagaaaccgacccggaaaaggacacaacuauaucgauggcaugacccaggaagaugcaacaugcaaaccuguaaccuacgccggcgcaugcuccagcuucgacguacuacuugagaaaggcaaauuuccacucuuucaaucuuacgcucaccaccgcacccuucuagaggccguccacgacacgaucauagcuaaagccgacccaccaagcugcgaccuccucucagcccauggcaacccaugcaugaaagagaaacucguaaugaaaacccacugccccaacgacuaccaguccgcucacuaccucaauaacgacggaaaaauggccucagucaaaugcccacccaaauacgagcuuacagaggacugcaacuucugccgccaaaugaccggagccucacucaagaaaggaagcuacccccuucaggaccuauucugccagagcucagaagacgacgguagcaagcuaaaaaccaaaaugaaagggguuugcgaggucggcguccaggcgcucaagaaaugcgacggucaacucucuacagcacaugaagucguacccuucgccguuuucaaaaacagcaagaaagucuaccucgacaaacuagaccucaaaaccgaagaaaaccuacuccccgacagcuucgugugcuucgaacacaaaggccaauauaaaggcacgauggacuccggacagaccaaaagggaacuaaaauccuucgacauaucccaaugccccaaaaucggaggccacggauccaagaaaugcaccggagacgccgccuucugcucagcauacgaaugcacagcacaauacgccaacgcauacugcagccacgcaaacggauccggaauagugcagauccaaguaagcggagucuggaagaaaccccucugugucggcuacgaacgcguggucguaaaaagagagcuuucagcuaaaccaauacaacgaguagaacccugcaccacgugcauuacaaaaugcgaaccacacggccucgucguucgcagcacugguuucaaaauaucuagcgcgguagcaugcgccucaggcguaugcgugaccggaucccagucaccaucaacagaaaucacccucaaauacccgggcauuucacaaucaucagguggcgacaucgggguacacauggcacacgacgaucaauccgucucuucaaaaaucgucgcccacugcccaccccaggaccccuguuuagugcacgacuguauagucugcgcccacggccuaauuaacuaccaaugccacaccgccauggccggaaucgcaaugacagucuuaccggcccucgcaguauucgcccuagccccaguugucuucgcagaagacugcucagaacuaauccaagccucuucccgaaucaccacaugcagcaccgaaggcgucaacacaaaaugccgccucucgggcaccgcccucauacgcgcaggcagcgucggcgccgaagcgugccuaaugcuuaaaggagucaaagaagaucaaaccaaauuucuaaaaaucaaaacugugagcucagaacucucaugcagagaaggacaaagcuacuggaccggaucauuuucuccuaaaugccugagcucucgcagaugccaccucguaggagagugccaugucaaccgcugucucucuuggcgagacaacgagaccuccgcagaguucagcuucguaggugaaucaacaaccaugcgagaaaacaaaugcuucgaacaaugcgguggcugggguugcggaugcuucaacgucaaccccucaugucucuucguccacacauaccuccaaagcguucgcaaagaagcucuacgcguauucaauugcauugauuggguacauaagcucacacuagaaaucacggacuuugacggcucagucucaaccaucgaucucggugcauccaguucgcgcuucacuaacuggggaagcgucucgcuuucccucgaugccgaaggcauauccggaucgaacucauucucguucauugaaucacccggcaaaggcuacgccaucguagaugaacccuucagugaaaucccgagacaaggauuccuaggagaaauccggugcaacuccgaaucgagcguccucuccgcacacgaauccugccuccgcgccccuaaucucaucuccuacaaaccaaugaucgaucaacucgaauguacaacaaaccugaucgaucccuucgucguguuugaacguggcucacucccccaaacccgcaaugacaaaacguucgccgcuucuaaaggcaaccggggcguccaggcuuucagcaagggcuccguccaagccgaccucacgcucauguucgacaacuucgaagucgacuucgucggagccgcuguuuccugugacgccgcauuucuaaacuuaaccgggugcuacagcugcaaugccggcgcaagaguaugccucuccaucaccucaaccggaacuggcucccuaagcgcccacaacaaagacggcucacuccacaucguccuaccaagcgaaaacggcacgaaagaccaaugccaaauccugcacuuuaccguacccgaagucgaagaggaguucauguauagcugcgacggcgacgaacgaccacuucuagucaaaggcacacucaucgccaucgaccccuucgacgaccgcagagaagcaggcggugaaucaacugugguaaaccccaaaucaggcagcuggaacuucuucgacugguucuccggacucaugagcugguucggcggcccccuuaagaccaucuuacucaucugccuauacgucgcacuauccaucggacucuucuuucuacucaucuaccucggccgcacaggccucucuaaaauguggcuagccgcaaccaagaaagcaaguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17348 - RNA, 3406 nt, Artificial Sequence
  mRNA product Design1 comprising derived and/or modified sequence from RVFV(ZH-548)__DQ380206.1__IgE-leader_Gn(delSP)-Gc-variant1 (opt11)
gggagaaagcuuaccauggacuggaccuggauacuguuccucguagccgccgcuacccgcguccauagugaagacccacaccuaagaaaccgccccggaaaagggcacaacuacauagaugguaugacacaagaggacgcgacguguaaacccguaaccuaugcuggagcuuguagcuccuuugauguccuucucgagaaaggaaaauucccccucuuccaauccuacgcccaccacagaacccuacucgaggcagugcaugacacaauaaucgcuaaagcagacccaccaucuugcgaucuauuaucugcucacggaaaccccugcaugaaagaaaagcuagucaugaaaacccacugccccaacgauuaccaaucagcacauuaccuuaauaacgacggcaaaauggccuccgucaaaugucccccaaaauacgaacucacagaggauugcaacuucugccgccagaugaccggcgccucccucaagaaaggguccuacccucuccaagaccuauucugccaauccuccgaagacgacggcuccaaauuaaaaacgaaaaugaaaggcgucugcgaagugggcguucaagcucucaagaaaugcgacggucaacuauccaccgcacacgaagucguucccuucgcagucuucaaaaauucuaagaaagucuaccuagacaaacuugaccuaaaaaccgaagagaaucuccuacccgacuccuucgucugcuucgaacacaaaggacaauacaaaggcaccauggauuccggccaaacaaaacgcgaacucaaauccuucgacaucucacaaugucccaaaauaggaggucacggaucgaagaaaugcaccggagacgcugccuucugcucugcauacgaaugcaccgcccaauaugccaacgccuacuguucacacgccaacggcuccggcauaguccaaauacaagucucgggcguauggaagaaaccccucugcguaggcuacgagcgagugguagucaaaagagaacucuccgccaaaccgauccaacgcgucgagccaugcacaacguguauuacaaaaugcgaaccacacgggcuaguuguccggucgaccggguucaaaaucucuucagccguagccugcgccucagguguaugcgucaccggaucacaauccccgagcaccgaaauaacccuaaaauacccggggaucagccagucguccggcggcgauaucggcguucacauggcgcacgacgaccagagcgucagcagcaaaaucgucgcccacuguccuccccaagaccccugccugguacacgacugcaucgucugcgcucacggccucauaaacuaccagugccauaccgcccuguccgccuucguugucguauucgucuucuccucaaucgccaucaucugccuagccauacuauaccgcguacucaaaugucuaaaaaucgcaccccgcaaaguacuuaacccucuaauguggaucaccgcauucauccgcuggaucuauaagaaaaugguagcccgggucgccgacaacaucaaccaagucaaccgugaaaucggauggauggaaggcggacaacucguccugggcaaccccgccccaaucccgcgacacgccccaaucccucgcuacuccaccuaccucaugcuacuacucaucguaagcuacgcuuccgcaugcuccgagcuaauccaggcuuccucccgcaucacaacuuguucaacagagggcguaaacacaaaauguagacugucuggcacagcccuaauacgugcaggaagcguaggagccgaagccugccucaugcuuaaaggaguaaaagaagaccaaacgaaauuucucaaaaucaaaacagucaguuccgagcucucaugccgcgaaggccaauccuacuggaccggcaguuucucccccaaaugccuaagcagucgccgcugccaccucgucggcgaaugccacguaaaucgauguuugucauggcgagauaaugaaaccuccgcagaguuuucauuuguaggcgaauccaccaccaugcgcgaaaacaaaugcuucgaacaaugcggagguuggggcugcggcugcuucaacgugaacccgucaugccucuucguucacaccuaucuucaauccgugcgcaaagaagcacuccgcguguuuaauugcaucgacuggguccacaaacuuacccuugaaauaacugacuucgacggcuccgucuccacaauagacuuaggagccucaucaucaagauucaccaauuggggaucaguuucccucucgcucgacgcugaagguauaaguggcaguaacucauucucauucaucgaaucacccggcaaaggcuaugcuaucguagaugagcccuuuuccgagaucccacgacaaggauuucuaggggaaauucgcuguaauucggaguccuccguccuaucggcccacgaaucaugccuccgcgccccaaaccucaucucguacaaacccaugaucgaccaguuggaaugcaccacaaaccucauugaccccuucguggucuucgaacgaggaagccucccccaaacacgcaacgacaaaaccuucgccgccucgaagggcaaccgcggcguacaagccuucaguaaaggaucgguccaagcagaccuuacccucauguucgacaacuucgaggucgacuucguuggagcggcgguguccugcgaugccgcauuccucaaccucacaggcugcuacuccugcaacgcuggagcacgcguaugcuuaucaauaaccucuacuggaacuggcucacuauccgcccacaacaaggacggcagccuccacaucguccucccaucagaaaacggcacaaaagaucagugccaaauacuccacuuuacggucccggaggucgaagaagaguucauguacagcugcgacggcgacgaacgcccccuccuaguaaaagguacccugauagcaaucgaccccuucgaugaccgccgagaggccggcggggaauccacaguggucaacccgaaauccggcagcuggaacuucuucgacugguucuccgggcuuauguccugguucggcggcccucucaaaacgauacuacuaaucugccuauacgucgcgcuguccauaggcuuauucuuccuacuaauauaccuugggcgcacuggccucucaaagauguggcuggccgccaccaagaaggccuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17349 - RNA, 3400 nt, Artificial Sequence
  mRNA product Design1 comprising derived and/or modified sequence from RVFV(ZH-548)__DQ380206.1__IgE-leader_Gn(delSP)-Gc-variant2 (opt11)
gggagaaagcuuaccauggauuggacguggauccuguuucucguggccgccgcgaccagaguccacagcccacaucucagaaaccgcccgggcaagggacacaacuacauagacggcaugacccaggaggacgcgaccugcaagcccgugaccuacgccggcgccuguagcagcuucgacguacugcuggagaagggcaaauucccccuguuccaguccuacgcacaccaccggacacugcucgaggcgguccaugacacaaucauagcuaaggccgacccucccucgugcgaccuucuauccgcgcacgggaaucccugcaugaaggagaagcucgucaugaagacccacugucccaacgacuaccagagcgcccacuaccugaacaacgacggcaaaauggccucugugaagugcccucccaaauacgagcucacagaggauugcaacuucugcaggcagaugacuggcgccucguuaaagaaagggucuuacccucugcaggaccuguucugccagagcuccgaagacgacggaagcaagcucaagacgaagaugaagggcgucugcgaggugggcgugcaggcccugaagaaaugcgacgggcagcuguccacugcccacgaggucguaccauucgcgguguucaaaaacagcaagaaagucuacuuggacaagcuggaucuuaagaccgaggagaaccuacuccccgacucuuuugugugcuucgagcauaaggggcaguauaagggcacgauggacaguggacagacaaagcgagagcugaaaaguuucgacauuagccagugcccgaaaaucggcggucacggcuccaagaagugcaccggcgacgccgccuucugcuccgccuacgaguguacugcccaguacgcgaacgccuacugcagccacgcaaaugggaguggcauagugcagauccaggucagcgggguauggaagaagccacuaugcgugggcuacgagcgcgugguggugaagcgggaacuguccgcuaagcccauccagcgcgucgagcccugcaccacuugcaucaccaagugcgagccccacgggcuggugguccggagcaccgguuucaaaauuuccagcgccgucgcgugcgcguccggugugugcgucaccgggagccagucccccagcacggagaucacccucaaguaccccggcaucucccagagcuccgggggcgacaucggggugcacauggcccacgacgaccaaucuguguccucaaagaucguggcccacugcccuccccaggaccccugccuggugcacgacugcaucgugugcgcccacggccugauaaacuaccagugccacacggcgcucagcgcguuuguuguaguguucgucuucagcuccaucgccaucaucugccuagccauucuguaccgggugcucaagugccugaagaucgcuccccggaaagugcugaauccucugauguggaucaccgccuucauccgguggaucuacaagaagaugguggcccggguugccgacaacaucaaccaagugaaccgcgagaucggcuggauggagggcgggcagcugguccuggggaacccggcccccaucccccgacacgcgcccaucccccgcuacucuacguaccucaugcugcugcucaucgugucguacgccucugcaugcagcgaguugauccaggcguccagcaggaucacaaccugcagcaccgagggcgucaacacgaagugccgccugaguggaaccgcccucauccgggcgggcuccguuggcgcugaggccugccugauguuaaaggggguaaaggaagaccaaaccaaauucuugaagaucaagaccgucagcuccgaacugagcugccgagaaggccaguccuacuggacggggucuuucagucccaagugccugagcucccgacgcugccaucucgucggugagugccacgucaaccgcugccucucauggcgggacaacgagacauccgccgaguucucauuugugggcgaguccaccaccaugcgcgagaacaagugcuuugagcagugcgguggcuggggcugcggaugcuucaacgucaaccccuccugccuguucguccauacguaccugcagagcgugcggaaggaggcccucagggucuucaacugcaucgacugggugcacaagcugacccuggagaucaccgacuucgacggcucuguguccaccauugacuugggcgcguccagcagcagauuuacgaacuggggcagcgucagucucagccuggacgccgaggggaucuccggcaguaacuccuucucguucaucgaguccccggggaagggcuacgccaucguagacgagcccuucucagagaucccccgccagggguuucucggcgagauucgcugcaacuccgaaagcucaguuuugagcgcccacgaaagcugucugcgcgcgccuaaccucaucuccuacaagcccaugaucgaccagcuggagugcacgaccaaccugaucgaccccuucguggucuucgagcggggcagccucccccagacccgcaacgacaagaccuucgccgccucaaaagggaacaggggcgugcaagccuucucaaagggguccguacaagccgaccuuacgcugauguucgacaacuuugagguugacuucgugggcgcggccguuagcugcgacgccgcguuucucaaccugaccggauguuacaguugcaaugcgggggcacgcgucugccuuucuaucaccagcaccggcacggggagccucuccgcccacaacaaggacggcucgcuacacaucguauuaccgagcgagaacgggaccaaggaccagugccagauucuccacuucaccguaccggagguggaggaggaguucauguacuccugcgacggugacgaacggccccuacugguaaaagggacccuaaucgccaucgaccccuucgacgaccgccgcgaggcgggcggcgaguccacggucgugaaccccaaaagcggguccuggaacuucuucgacugguucagcggccugaugagcugguucgggggcccguuaaagacuauccuccuuauuugccuguauguggcgcucagcaucggccuguucuuuuuauuaauauaccuggggcgcaccggccugagcaagauguggcucgcggcuacaaagaaggccuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17350 - RNA, 1885 nt, Artificial Sequence
  mRNA product Design1 comprising derived and/or modified sequence from RVFV(ZH-548)__DQ380206.1__IgE-leader_Gn(delSP)-variant1 (opt11)
gggagaaagcuuaccauggacuggaccuggauccucuuccuagucgccgcagccacccgcguccacuccgaagacccacaccuacggaaccgcccaggaaaaggacacaacuacauugacggcaugacccaagaggacgcaaccugcaaaccaguaacauacgccggcgccugcuccuccuucgacguccuccuagaaaaaggcaaauucccacuauuccaauccuacgcccaccaccgaacacugcucgaagccguacacgacaccaucauagcaaaagccgacccaccuuccugcgaccuccucuccgcccacggcaaccccugcaugaaggaaaaacucgucaugaagacccacugccccaacgacuaccagagcgcccacuaccucaacaacgacggcaagauggcuagcgucaagugucccccaaaauacgaacucacugaagacugcaacuucugccgccaaaugacaggggcaucucucaagaaaggcuccuacccacuccaagaccuguucugccaaucaagcgaagacgacggauccaaacucaaaaccaaaaugaaaggagucugcgaaguuggcguccaagcccucaagaaaugcgauggccaacuaucaacagcucacgaagucguccccuucgccgucuucaaaaacucuaagaaagucuaccucgacaaacucgaccucaaaaccgaagaaaaccuacuccccgauucauucgucugcuucgaacacaaaggccaguacaaaggaaccauggacucaggccaaacaaaacgcgaacuaaaaucauucgacaucucacaaugcccaaaaaucgguggacacggcucaaagaaaugcaccggagaugcggccuucugcagcgccuacgaaugcaccgcucaauaugcaaacgccuacugcucccacgccaacggcucaggaaucguccagauccaaguauccggagucuggaagaaaccccuaugcgucggcuacgaacgcguaguaguaaaacgagaacucuccgccaaaccuauacaacgcguagaacccugcacaacaugcauaacaaaaugcgagccccacggccuagucguccgcuccaccggauucaaaauuuccucugcagucgcaugcgccucaggagucugcgucacaggcucacaaucgcccucaaccgaaaucacucucaaauacccaggcaucagccaaagcuccggcggagacaucggaguccacauggcccacgacgaccaauccgucuccagcaaaauaguggcacacugcccuccacaggaucccugccucguucacgacugcaucgucugcgcccacggccucauaaacuaccaaugccacaccgcccucuccgcguucgucgucguuuucguauucucguccaucgcaaucaucugccuugcaauccucuaccggguccucaaaugucuaaaaaucgcaccccgaaaaguccucaacccucuaauguggauaacagccuucauaagauggaucuacaagaaaauggucgcccgcguagccgacaacaucaaccaggucaaccgagaaaucggcuggauggaaggaggccaacucguccucggcaacccagccccuaucccacgacacgcacccaucccccgcuacuccaccuaccucaugcuccuacucauaguauccuacgccuccgccuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17351 - RNA, 1879 nt, Artificial Sequence
  mRNA product Design1 comprising derived and/or modified sequence from RVFV(ZH-548)__DQ380206.1__IgE-leader_Gn(delSP)-variant2 (opt11)
gggagaaagcuuaccauggacuggaccuggauccucuuccucgucgcugcagcaacacgcguccacucgccacaccuucgcaacagaccaggcaaaggccacaacuacauagacggaaugacacaagaagacgcaaccugcaaacccgucacauacgccggcgcaugcucauccuucgacguccuacuagaaaagggcaaauucccccuauuccaauccuacgcccaccaccgaacccuccuagaagccguccacgacaccaucauagcaaaggccgauccucccuccugcgaccugcugucagcacacggcaaucccugcaugaaagaaaagcuagucaugaaaacacacugccccaacgacuaccaaagcgcccacuaucucaacaacgacggcaaaauggcaucagucaaaugcccacccaaauacgaacugaccgaagacuguaacuucugccgccaaaugaccggcgccucucucaagaaaggaucauacccccuccaagaccuauucugccaauccagugaagacgacggauccaaacucaaaaccaaaaugaaaggcgucugcgaaguuggagugcaggcccucaagaaaugcgacggccaacuuuccaccgcccaugagguaguacccuucgccguauucaaaaacucgaagaaaguauaccuagacaaacucgacuuaaaaaccgaagaaaaccuccuccccgacucauucgucugcuucgaacacaaaggccaauacaaaggcaccauggacuccggacaaaccaaacgcgaacucaaauccuucgacaucagccaaugucccaaaauaggaggacacggcagcaagaaaugcaccggcgacgccgcauuuugcucagccuacgaaugcacagcacaauacgcaaacgcauacugcucacacgcaaacggcuccggaaucguccaaauccaaguauccgguguuuggaagaaaccccucugcgucggauacgaacgcgucguugucaaaagagaacucucagccaaaccaauccaacgcgucgaacccugcacaaccugcaucaccaaaugcgaaccucacgggcuagucguccgauccaccgguuucaaaaucucaagcgccgucgccugugccagcgguguaugcguaaccggaucccaaucuccaucaaccgaaaucacucuaaaauaccccggaauaagccaguccuccggaggagacauaggcguccacauggcacacgacgaccaaucagucucauccaaaauaguagcacacugcccgccacaagacccaugccuaguccacgauugcaucgucugcgcccacggccuaaucaacuaucaaugccacaccgcacucagcgcauucguggucgucuucgucuucuccagcaucgcaaucauaugccucgccauccucuaccgcguacucaaaugccuaaaaauagccccucgaaaaguucucaacccccucauguggaucaccgcuuuuauccgauggaucuacaagaaaaugguagcucgagucgccgauaacaucaaccaaguaaaccgcgaaaucggauggauggaaggcggccaacucguccuaggaaauccggcccccauaccuagacacgcacccaucccucgcuacucaaccuaccuuaugcuacuccuuauaguaucuuacgcauccgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17352 - RNA, 1795 nt, Artificial Sequence
  mRNA product Design1 comprising derived and/or modified sequence from RVFV(ZH-548)__DQ380206.1__IgE-leader_Gc (opt11)
gggagaaagcuuaccauggacuggacauggauccucuuccucguggccgcagccacaagaguccacucgugcuccgaacuuauccaagccuccagccgaaucacaaccugcagcaccgaaggcguaaauaccaaaugccgacucuccggcaccgcccuaauccgcgcaggcucaguaggcgccgaagccugccuuaugcucaaaggagucaaagaagaccaaaccaaauuccucaaaaucaagaccguaagcagcgaacuaagcugccgagaaggccagagcuauuggacaggcucauucucacccaaaugccucaguucccgcagaugccaccuagucggcgaaugccacgucaaccggugccucucauggcgggacaacgaaaccagcgcggaauuuagcuucguaggagaaucaacuaccaugcgagaaaauaagugcuucgagcaaugcggcggcuggggaugcggcugcuucaacguaaaccccucaugccuauucguccacacauaccuccaauccguccgcaaggaagcccuacgcgucuuuaacugcauugacugggugcacaaacuuacacucgaaaucacggacuucgacggcagcgucagcacaauagaccucggcgccuccagcucccgcuucaccaauuggggcuccguaagccucucccuggacgcagaaggcaucucaggcuccaauucguucuccuucauagaaucaccugggaaaggcuacgccaucguagacgaacccuucagcgaaauuccacgccaaggcuuccuaggagaaauccgcugcaacucugaaucaagcguacucuccgcccacgaauccugucuacgcgcccccaaucuaaucagcuacaaacccaugauugaccaacucgaaugcacaaccaauuuaaucgacccauuugucgucuucgagcgcggaucacuaccacaaacccgaaacgacaaaaccuucgcagcaagcaagggaaaccgcgguguacaagccuucagcaaaggcuccguccaagcagaccuuacacuaauguucgacaacuucgaagucgacuucgucggcgccgccgucagcugcgacgccgccuuccugaaccucacgggcuguuacagcugcaacgccggcgcacgcgucugccuaucuaucaccucgaccggcacaggaucacuauccgcacacaacaaagacggaucgcuccacaucguacucccaagcgaaaacggcaccaaggaccagugccaaauccugcacuucaccguaccagaaguagaagaagaguucauguacucaugcgacggcgacgaaagaccacugcucgugaaaggcacccuuauagcgaucgacccauucgacgaccgacgagaagcaggaggcgaaucaacaguuguaaaccccaaaagcggaaguuggaacuucuucgacugguucagcgggcucaugagcugguucggaggaccacucaaaaccauacuccucaucugccucuacgucgcacucagcaucgggcuuuucuuccuccucaucuaccugggccgcaccggacuaucaaaaauguggcucgccgccaccaagaaagcaagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17353 - RNA, 1120 nt, Artificial Sequence
  mRNA product Design2 comprising derived and/or modified sequence from RVFV(ZH-548)__DQ380151.1__N (wt)
ggggcgcugccuacggagguggcagccaucuccuucucggcaucaagcuuaccauggacaacuaucaagagcuugcgauccaguuugcugcucaagcaguggaccgcaaugagauugaacaguggguccgagaguuugcuuaucaaggguuugaugcccguagaguuaucgaacucuuaaagcaguaugguggggcugacugggagaaggaugccaagaaaaugauuguucuggcucuaacucguggcaacaagcccaggaggaugaugaugaaaaugucgaaagaaggcaaagcaacuguggaggcucucaucaacaaguauaagcuaaaggaagggaauccuucccgggaugaguugacucuaucacgaguugcugccgccuuggcuggcuggacaugccaggcuuuggucgucuugagugaguggcuuccugucacugggacuaccauggacggccuauccccugcauacccgaggcauaugaugcaccccagcuuugcuggcaugguggauccuucucuaccaggagacuaucuaagggcaauauuagaugcucacucucuguaucugcugcaguucucccgggucaucaacccaaaccuccgagguagaacaaaagaggagguugcugcaacguucacgcagccaaugaaugcagcagugaauagcaacuuuauaagccaugagaagaggagagaauucuugaaagccuuuggacuuguggauuccaaugggaagccgucagcugcugucauggcagccgcucaggcuuacaagacagcagccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17354 - RNA, 1120 nt, Artificial Sequence
  mRNA product Design2 comprising derived and/or modified sequence from RVFV(ZH-548)__DQ380151.1__N (wt)
ggggcgcugccuacggagguggcagccaucuccuucucggcaucaagcuuaccauggacaacuaucaagagcuugcgauccaguuugcugcucaagcaguggaccgcaaugagauugaacaguggguccgagaguuugcuuaucaaggguuugaugcccguagaguuaucgaacucuuaaagcaguaugguggggcugacugggagaaggaugccaagaaaaugauuguucuggcucuaacucguggcaacaagcccaggaggaugaugaugaaaaugucgaaagaaggcaaagcaacuguggaggcucucaucaacaaguauaagcuaaaggaagggaauccuucccgggaugaguugacucuaucacgaguugcugccgccuuggcuggcuggacaugccaggcuuuggucgucuugagugaguggcuuccugucacugggacuaccauggacggccuauccccugcauacccgaggcauaugaugcaccccagcuuugcuggcaugguggauccuucucuaccaggagacuaucuaagggcaauauuagaugcucacucucuguaucugcugcaguucucccgggucaucaacccaaaccuccgagguagaacaaaagaggagguugcugcaacguucacgcagccaaugaaugcagcagugaauagcaacuuuauaagccaugagaagaggagagaguucuugaaagccuuuggacuuguggauuccaaugggaagccgucagcugcugucauggcagccgcucaggcuuacaagacagcagccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17355 - RNA, 3976 nt, Artificial Sequence
  mRNA product Design2 comprising derived and/or modified sequence from RVFV(ZH-548)__DQ380206.1__GP (wt)
ggggcgcugccuacggagguggcagccaucuccuucucggcaucaagcuuaccauguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugccaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17356 - RNA, 3976 nt, Artificial Sequence
  mRNA product Design2 comprising derived and/or modified sequence from RVFV(ZH-548)__DQ380206.1__GP (wt)
ggggcgcugccuacggagguggcagccaucuccuucucggcaucaagcuuaccauguauguuuuauuaacaauucuaaucucgguucuggugugugaagcgguuauuagagugucucuaagcuccacaagagaagagaccugcuuuggugacuccacuaacccagagaugauugaaggagcuugggauucacucagagaggaggagaugccggaggagcucuccuguucuauaucaggcauaagagagguuaagaccucaagccaggaguuauacagggcauuaaaagccaucauugcugcugauggcuugaacaacaucaccugucaugguaaggauccugaggacaagauuucccucauaaaggguccuccucacaaaaagcggguggggauaguucggugugagagacgaagagaugcuaagcaaauagggagagaaaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17357 - RNA, 3586 nt, Artificial Sequence
  mRNA product Design2 comprising derived and/or modified sequence from RVFV(ZH-548)__DQ380206.1__Gn-Gc (wt)
ggggcgcugccuacggagguggcagccaucuccuucucggcaucaagcuuaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17358 - RNA, 3586 nt, Artificial Sequence
  mRNA product Design2 comprising derived and/or modified sequence from RVFV(ZH-548)__DQ380206.1__Gn-Gc (wt)
ggggcgcugccuacggagguggcagccaucuccuucucggcaucaagcuuaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17359 - RNA, 3337 nt, Artificial Sequence
  mRNA product Design2 comprising derived and/or modified sequence from RVFV(ZH-548)__DQ380206.1__Gne_SP-Gn_Gc (wt)
ggggcgcugccuacggagguggcagccaucuccuucucggcaucaagcuuaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcuauggcagggauugcaaugacaguccuuccagccuuagcaguuuuugcuuuggcaccuguuguuuuugcugaagacuguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17360 - RNA, 3337 nt, Artificial Sequence
  mRNA product Design2 comprising derived and/or modified sequence from RVFV(ZH-548)__DQ380206.1__Gne_SP-Gn_Gc (wt)
ggggcgcugccuacggagguggcagccaucuccuucucggcaucaagcuuaccauggcagggauugcaaugacaguccuuccagccuuagcaguuuuugcuuuggcaccuguuguuuuugcugaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcuauggcagggauugcaaugacaguccuuccagccuuagcaguuuuugcuuuggcaccuguuguuuuugcugaagacuguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17361 - RNA, 3571 nt, Artificial Sequence
  mRNA product Design2 comprising derived and/or modified sequence from RVFV(ZH-548)__DQ380206.1__IgE-leader_Gn(delSP)-Gc-variant1 (wt)
ggggcgcugccuacggagguggcagccaucuccuucucggcaucaagcuuaccauggacuggaccuggauccuguuccucguggccgccgcgacccgcguccacagcgaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17362 - RNA, 3571 nt, Artificial Sequence
  mRNA product Design2 comprising derived and/or modified sequence from RVFV(ZH-548)__DQ380206.1__IgE-leader_Gn(delSP)-Gc-variant1 (wt)
ggggcgcugccuacggagguggcagccaucuccuucucggcaucaagcuuaccauggacuggaccuggauccuguuccucguggccgccgcgacccgcguccacagcgaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17363 - RNA, 3565 nt, Artificial Sequence
  mRNA product Design2 comprising derived and/or modified sequence from RVFV(ZH-548)__DQ380206.1__IgE-leader_Gn(delSP)-Gc-variant2 (wt)
ggggcgcugccuacggagguggcagccaucuccuucucggcaucaagcuuaccauggacuggaccuggauccuguuccucguggccgccgcgacccgcguccacagcccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17364 - RNA, 3565 nt, Artificial Sequence
  mRNA product Design2 comprising derived and/or modified sequence from RVFV(ZH-548)__DQ380206.1__IgE-leader_Gn(delSP)-Gc-variant2 (wt)
ggggcgcugccuacggagguggcagccaucuccuucucggcaucaagcuuaccauggacuggaccuggauccuguuccucguggccgccgcgacccgcguccacagcccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17365 - RNA, 2050 nt, Artificial Sequence
  mRNA product Design2 comprising derived and/or modified sequence from RVFV(ZH-548)__DQ380206.1__IgE-leader_Gn(delSP)-variant1 (wt)
ggggcgcugccuacggagguggcagccaucuccuucucggcaucaagcuuaccauggacuggaccuggauccuguuccucguggccgccgcgacccgcguccacagcgaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17366 - RNA, 2050 nt, Artificial Sequence
  mRNA product Design2 comprising derived and/or modified sequence from RVFV(ZH-548)__DQ380206.1__IgE-leader_Gn(delSP)-variant1 (wt)
ggggcgcugccuacggagguggcagccaucuccuucucggcaucaagcuuaccauggacuggaccuggauccuguuccucguggccgccgcgacccgcguccacagcgaagacccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17367 - RNA, 2044 nt, Artificial Sequence
  mRNA product Design2 comprising derived and/or modified sequence from RVFV(ZH-548)__DQ380206.1__IgE-leader_Gn(delSP)-variant2 (wt)
ggggcgcugccuacggagguggcagccaucuccuucucggcaucaagcuuaccauggacuggaccuggauccuguuccucguggccgccgcgacccgcguccacagcccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuugaccuuaagacugaggagaaucugcuaccagacucauuugucuguuucgagcauaagggacaguacaaaggaacaauggacucuggucagacuaagagggagcucaaaagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17368 - RNA, 2044 nt, Artificial Sequence
  mRNA product Design2 comprising derived and/or modified sequence from RVFV(ZH-548)__DQ380206.1__IgE-leader_Gn(delSP)-variant2 (wt)
ggggcgcugccuacggagguggcagccaucuccuucucggcaucaagcuuaccauggacuggaccuggauccuguuccucguggccgccgcgacccgcguccacagcccccaucucagaaacagaccagggaaggggcacaacuacauugacgggaugacucaggaggaugccacaugcaaaccugugacauaugcuggggcauguagcaguuuugaugucuugcuugaaaagggaaaauuuccccuuuuccagucguaugcucaucauagaacucuacuagaggcaguucacgacaccaucauugcaaaggcugauccaccuagcugugaccuucugagugcucaugggaaccccugcaugaaagagaaacucgugaugaagacacacuguccaaaugacuaccagucagcucauuaccucaacaaugacgggaaaauggcuucagucaagugcccuccuaaguaugagcucacugaggacugcaacuuuuguaggcagaugacaggugcuagccugaagaaggggucuuauccucuccaagacuuguuuugucagucaagugaggaugauggaucaaaauuaaaaacaaaaaugaaaggggucugcgaaguggggguucaagcacucaaaaagugugauggccaacucagcacugcacaugagguugugcccuuugcaguguuuaagaacucaaagaagguuuaucuugauaagcuggaccuuaagacugaggagaaucugcuaccagacucauuugucuguuucgagcauaagggacaguacaaaggaacaauggacucuggucagacuaagagggagcucaagagcuuugauaucucucagugccccaagauuggaggacaugguaguaagaagugcacuggggacgcagcauuuugcucugcuuaugagugcacugcucaguacgccaaugccuauuguucacaugcuaaugggucagggauugugcagauacaaguaucaggggucuggaagaagccuuuauguguaggguaugagagagugguugugaagagagaacucucugccaagcccauccagagaguugagccuugcacaacuuguauaaccaaaugugagccucauggauugguuguccgaucaacaggguucaagauaucaucagcaguugcuugugcuagcggaguuugcgucacaggaucgcagaguccuuccaccgagauuacacucaaguauccagggauaucccagucuucugggggggacauagggguucacauggcacacgaugaucagucaguuagcuccaaaauaguagcucacugcccuccccaggacccgugcuuagugcaugacugcauagugugugcucauggccugauaaauuaccagugucacacugcucucagugccuuuguuguuguguuuguauucaguucuauugcaauaauuuguuuagcuauucuuuauagggugcuuaagugccugaagauugccccaaggaaaguucugaauccacuaauguggaucacagccuucaucagauggauauauaagaagaugguugccagaguggcagacaacauuaaucaagugaacagggaaauaggauggauggaaggaggucaguugguucuagggaacccugccccuauuccucgucaugccccaaucccacguuauagcacauaccugauguuauuauugauugucucauaugcaucagcauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17369 - RNA, 1960 nt, Artificial Sequence
  mRNA product Design2 comprising derived and/or modified sequence from RVFV(ZH-548)__DQ380206.1__IgE-leader_Gc (wt)
ggggcgcugccuacggagguggcagccaucuccuucucggcaucaagcuuaccauggacuggaccuggauccuguuccucguggccgccgcgacccgcguccacagcuguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaagcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17370 - RNA, 1960 nt, Artificial Sequence
  mRNA product Design2 comprising derived and/or modified sequence from RVFV(ZH-548)__DQ380206.1__IgE-leader_Gc (wt)
ggggcgcugccuacggagguggcagccaucuccuucucggcaucaagcuuaccauggacuggaccuggauccuguuccucguggccgccgcgacccgcguccacagcuguucagaacugauucaggcaagcuccagaaucaccacuugcucuacagaggguguuaacaccaaguguagacugucuggcacagcauugaucagagcagggucaguuggggcagaggcuuguuugauguugaagggggucaaggaagaucaaaccaaguucuuaaagauaaaaacugucucaagugagcuaucaugcagggagggccagaguuauuggacuggguccuuuagcccuaaauguuugagcucaaggagaugccaccuugucggggaaugccaugugaauaggugucugucuuggagggacaaugaaacuucagcagaguuuucauuuguuggggaaagcacgaccaugcgagagaauaaguguuuugagcaauguggaggauggggguguggguguuucaaugugaacccaucuugcuuauuugugcacacguaucugcagucaguuagaaaagaggcccuuagaguuuuuaacuguaucgacugggugcauaaacucacucuagagaucacagacuuugauggcucuguuucaacaauagacuugggagcaucaucuagccguuucacaaacugggguucaguuagccucucacuggacgcagagggcauuucaggcucaaauagcuuuucuuucauugagagcccaggcaaaggguaugcaauuguugaugagccauucucagaaauuccucggcaaggguucuugggggagaucaggugcaauucagaguccucaguccugagugcucaugaaucaugccuuagggcaccaaaccuuaucucauacaagcccaugauagaucaauuggagugcacaacaaaucugauugaucccuuuguugucuuugagagggguucucugccacagacaaggaaugacaaaaccuuugcagcuucaaaaggaaauagagguguucaggcuuucucuaagggcucuguacaagcugaucuaacucugauguuugacaauuuugagguggacuuugugggagcagccguaucuugugaugccgccuucuuaaauuugacagguugcuauucuugcaaugcaggggccagggucugccugucuaucacauccacaggaacuggaucucucucugcccacaauaaggaugggucucugcauauaguccuuccaucagagaauggaacaaaagaccagugucagauacuacacuucacugugccugaaguagaggaggaguuuauguacucuugugauggagaugagcggccucuguuggugaaggggacccugauagccauugauccauuugaugauaggcgggaagcagggggggaaucaacaguugugaauccaaaaucuggaucuuggaauuucuuugacugguuuucuggacucaugaguugguuuggagggccucuuaaaacuauacuccucauuugccuguauguugcauuaucaauugggcucuuuuuccuccuuauauaucuuggaagaacaggccucucuaaaauguggcuugcugccacuaagaaggccucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17371 - RNA, 1120 nt, Artificial Sequence
  mRNA product Design2 comprising derived and/or modified sequence from RVFV(ZH-548)__DQ380151.1__N (opt4)
ggggcgcugccuacggagguggcagccaucuccuucucggcaucaagcuuaccauggacaacuaccaggagcuggccauccaguucgccgcccaggccguggacagaaacgagaucgagcagugggugagagaguucgccuaccagggcuucgacgccagaagagugaucgagcugcugaagcaguacggcggcgccgacugggagaaggacgccaagaagaugaucgugcuggcccugaccagaggcaacaagcccagaagaaugaugaugaagaugagcaaggagggcaaggccaccguggaggcccugaucaacaaguacaagcugaaggagggcaaccccagcagagacgagcugacccugagcagaguggccgccgcccuggccggcuggaccugccaggcccugguggugcugagcgaguggcugcccgugaccggcaccaccauggacggccugagccccgccuaccccagacacaugaugcaccccagcuucgccggcaugguggaccccagccugcccggcgacuaccugagagccauccuggacgcccacagccuguaccugcugcaguucagcagagugaucaaccccaaccugagaggcagaaccaaggaggagguggccgccaccuucacccagcccaugaacgccgccgugaacagcaacuucaucagccacgagaagagaagagaguuccugaaggccuucggccugguggacagcaacggcaagcccagcgccgccgugauggccgccgcccaggccuacaagaccgccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17372 - RNA, 3976 nt, Artificial Sequence
  mRNA product Design2 comprising derived and/or modified sequence from RVFV(ZH-548)__DQ380206.1__GP (opt4)
ggggcgcugccuacggagguggcagccaucuccuucucggcaucaagcuuaccauguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugucacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17373 - RNA, 3586 nt, Artificial Sequence
  mRNA product Design2 comprising derived and/or modified sequence from RVFV(ZH-548)__DQ380206.1__Gn-Gc (opt4)
ggggcgcugccuacggagguggcagccaucuccuucucggcaucaagcuuaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17374 - RNA, 3337 nt, Artificial Sequence
  mRNA product Design2 comprising derived and/or modified sequence from RVFV(ZH-548)__DQ380206.1__Gne_SP-Gn_Gc (opt4)
ggggcgcugccuacggagguggcagccaucuccuucucggcaucaagcuuaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgccauggccggcaucgccaugaccgugcugcccgcccuggccguguucgcccuggcccccgugguguucgccgaggacugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17375 - RNA, 3571 nt, Artificial Sequence
  mRNA product Design2 comprising derived and/or modified sequence from RVFV(ZH-548)__DQ380206.1__IgE-leader_Gn(delSP)-Gc-variant1 (opt4)
ggggcgcugccuacggagguggcagccaucuccuucucggcaucaagcuuaccauggacuggaccuggauccuguuccugguggccgccgccaccagagugcacagcgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17376 - RNA, 3565 nt, Artificial Sequence
  mRNA product Design2 comprising derived and/or modified sequence from RVFV(ZH-548)__DQ380206.1__IgE-leader_Gn(delSP)-Gc-variant2 (opt4)
ggggcgcugccuacggagguggcagccaucuccuucucggcaucaagcuuaccauggacuggaccuggauccuguuccugguggccgccgccaccagagugcacagcccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17377 - RNA, 2050 nt, Artificial Sequence
  mRNA product Design2 comprising derived and/or modified sequence from RVFV(ZH-548)__DQ380206.1__IgE-leader_Gn(delSP)-variant1 (opt4)
ggggcgcugccuacggagguggcagccaucuccuucucggcaucaagcuuaccauggacuggaccuggauccuguuccugguggccgccgccaccagagugcacagcgaggacccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17378 - RNA, 2044 nt, Artificial Sequence
  mRNA product Design2 comprising derived and/or modified sequence from RVFV(ZH-548)__DQ380206.1__IgE-leader_Gn(delSP)-variant2 (opt4)
ggggcgcugccuacggagguggcagccaucuccuucucggcaucaagcuuaccauggacuggaccuggauccuguuccugguggccgccgccaccagagugcacagcccccaccugagaaacagacccggcaagggccacaacuacaucgacggcaugacccaggaggacgccaccuguaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagaguuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccuguaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17379 - RNA, 1960 nt, Artificial Sequence
  mRNA product Design2 comprising derived and/or modified sequence from RVFV(ZH-548)__DQ380206.1__IgE-leader_Gc (opt4)
ggggcgcugccuacggagguggcagccaucuccuucucggcaucaagcuuaccauggacuggaccuggauccuguuccugguggccgccgccaccagagugcacagcugcagcgagcugauccaggccagcagcagaaucaccaccuguagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17380 - RNA, 1120 nt, Artificial Sequence
  mRNA product Design2 comprising derived and/or modified sequence from RVFV(ZH-548)__DQ380151.1__N (opt3)
ggggcgcugccuacggagguggcagccaucuccuucucggcaucaagcuuaccauggacaacuaccaggagcuggccauccaauucgcugcacaggccguggauagaaaugaaauugagcagugggucagggaauuugcguaucagggcuucgacgcucggcgcguuauagagcuccuuaagcaauacgggggagccgauugggaaaaagacgcaaagaaaaugaucgugcuggccuugacccgagguaacaagccccguagaaugaugaugaaaaugagcaaggagggcaaggcuacaguagaggcauuaauuaauaaauauaagcugaaagaagggaacccuuccagggaugagcuaacucucucucggguggccgcugcccuggcgggauggacgugccaggcacuugucgugcugucagaaugguugccaguuaccggcacaacuauggacggucucaguccggccuacccccgccacaugaugcauccuagcuuugcugggaugguggauccaucccugcccggagacuaucugagagccauccucgaugcacacucuuuauaccugcuucaguucucgagggucauuaauccuaacuugcggggccgcaccaaggaggagguggcugccacauuuacccagccaaugaaugcggccguaaacucaaauuucaucagccaugaaaaacgaagagaguuucugaaggcauucggccuaguugacaguaacgggaagcccuccgcugccgugauggcugccgcacaagccuauaaaacugcugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17381 - RNA, 3976 nt, Artificial Sequence
  mRNA product Design2 comprising derived and/or modified sequence from RVFV(ZH-548)__DQ380206.1__GP (opt3)
ggggcgcugccuacggagguggcagccaucuccuucucggcaucaagcuuaccauguacgugcugcucaccauccuuauuagcguccugguuugcgaggccgugauaagaguauccuugucuucaacaagggaagagacuuguuucggcgacaguacgaaccccgaaaugaucgagggggcuugggauagcuuacgggaagaggagaugccugaagaacuguccugcucuauuucgggaauccgcgaagugaagaccucaagccaggagcuauaucgagcacucaaagccauuaucgcggcugacggucugaauaacauaacaugucacggcaaggauccagaggacaaaaucagucuuauuaaggggccgccccauaaaaagcgugucggaaucgugagaugcgaaaggcggcgcgaugccaagcaaauuggcagagagacuauggcagguaucgccaugaccguucugccugcuuuggcaguguuugcccucgcuccagucguguucgccgaagacccccaccugaggaaucggccugggaaaggacauaacuacauagauggcaugacacaggaggacgcgaccuguaagccaguaacuuaugcaggcgccugcuccucuuuugauguucugcucgaaaaagggaaguuccccuuauuucagagcuacgcucaccaucgcacacugcuugaggccgugcacgacaccauuaucgcaaaagcugauccuccauccugugacuugcugucagcccacggaaauccgugcaugaaggagaagcuagucaugaaaacgcauugucccaacgauuaucagagugcgcacuaccucaauaacgacgguaagauggccagcgugaaaugcccuccaaaguaugaacugacugaggacuguaauuucugccgacaaaugaccggcgcaucucuuaaaaagggguccuacccccugcaggauuuguuuugccagucaagcgaagacgauggaaguaaacucaagacaaagaugaaaggcgugugugaggucgguguucaggcucugaagaaaugcgacgggcaauuaucuacugcccaugaagugguaccuuucgcuguguuuaagaacuccaaaaaggucuaccuggauaagcucgaccuuaaaaccgaggagaaucuguugccagauagcuucguguguuuugaacacaagggacaguauaaaggcacaauggacucgggccagaccaagagagagcuaaaaucuuucgauauuucccagugccccaagaucgggggacacgguucaaagaaauguacgggcgacgccgcauuuugcagugccuacgaauguacugcucaauaugcgaacgcauacugcagccaugccaauggguccggaaucguucagauucaggugucuggcgucuggaagaaaccgcuguguguggguuaugagaggguaguugugaagcgggaacucagcgcuaaaccuauacaacgugucgagcccugcacaaccuguaucacuaagugcgagccacacgggcuggugguccgcucaacaggcuucaagauuaguuccgccguggcaugcgccagcggaguuugugugaccggcucucagucaccuaguacggaaaucacccuuaaauaccccgggauaagccaguccucuggaggugauauuggcguacauauggcucacgacgaccagucggucagcuccaagaucguggcccauugcccaccccaagauccuugucugguucacgacugcaucgugugugcacacggguugauuaacuaucagugccauacagcgcucucagcuuucgucgugguauuuguguucaguucuaucgccauuauaugucuggcaaucuuauacagaguucugaaaugccuaaagauugccccaaggaaaguccucaauccgcugauguggaucacugcuuuuauccgguggauuuacaagaaaaugguggcccgaguggcagauaacauaaaccaggucaaucgcgagaucggauggauggaaggcggucagcuuguuuuggggaaccccgcuccuauuccaagacacgcccccaucccuagguauagcaccuaccugaugcuccugcuuauuguguccuaugcgucagccuguagcgagcugauccaggcuucuucccggauaacaacuugcaguaccgagggcgugaauacaaagugucgcuugagcggaaccgcacucaucagagccggcucuguaggggcugaagccugccugauguuaaagggagucaaagaggaccaaacuaaguuccugaaaauuaagacgguguccucagaacuaaguugcagggagggucagagcuacuggacaggcucguuuuccccaaaaugucucucuagccgucggugccaucugguuggggaaugucacgugaaccgaugccuuucauggagagauaaugagaccagugcagaguucuccuuugucggagaaucuacuaccaugagggagaacaaguguuucgaacagugcggcgguuggggguguggcugcuuuaaugugaaccccagcuguuuguucguucacacauaucugcaauccgugcgcaaggaggcgcuccggguauuuaauugcaucgacuggguccauaaacugaccuuagaaauuacugauuucgacggaucagugagcacaaucgaucugggcgccaguucuuccagauuuacgaacugggggagcgugucgcuuucauuggacgcugagggaauaucuggcaguaauuccuucagcuucauugagucuccggguaagggguacgccaucgucgaugaaccuuuuagcgagauuccaaggcagggauuccucggcgaaauccgcuguaacuccgagucaaguguucugagcgcacacgaaucuugccuacgagcucccaaucugauauccuauaaaccuaugaucgaccagcucgagugcaccacuaaccugauugaucccuuugugguauucgagcgggguucacuuccacagacacguaaugacaagaccuuugccgcaaguaaaggcaacagaggggugcaagccuucagcaagggauccguccaggcugacuugacacugauguuugauaacuucgaaguggacuuuguuggcgcggccgugucuugugaugcagcuuucuuaaaucucacugggugcuacucguguaacgccggagccagggucugccugagcaucaccucaacgggcaccgguucccuuagugcucauaauaaggacgggucucugcacauuguguugccuagcgagaacggaacaaaagaucagugucaaauccuccauuuuacuguucccgaaguggaggaggaguucauguacuccugcgacggcgaugagcgcccacugcuagucaaggguacccugauagcaauugacccguuugaugaccggagagaagccggcggggagucaacaguagugaauccuaaaucuggaagcuggaacuucuucgauugguuuaguggccucauguccugguucgggggaccccugaagacuauccuuuugaucugucuguauguugcguuaagcauuggccucuuuuuccugcuuaucuaccuggguaggaccgggcuaucuaaaauguggcucgcugccacgaagaaggcaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17382 - RNA, 3586 nt, Artificial Sequence
  mRNA product Design2 comprising derived and/or modified sequence from RVFV(ZH-548)__DQ380206.1__Gn-Gc (opt3)
ggggcgcugccuacggagguggcagccaucuccuucucggcaucaagcuuaccauggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcuuagugcgcauggaaacccuuguaugaaagagaagcuggugaugaagacucacugcccaaaugauuaucagagcgcacacuacuugaacaaugacggcaaaauggccuccguuaagugucccccuaaauaugaacucaccgaggauugcaacuuuugucgccagaugacaggugcuucucugaagaaagggucguacccacugcaggaccucuucugccaaucaagcgaggaugacggaaguaaguuaaagaccaaaaugaagggcgugugugaagucggcgugcaggcccugaaaaagugcgaugggcagcuuuccacugcacaugagguaguuccguuugcuguguucaaaaauucuaagaaagucuauuuggacaagcuggaccuaaagacagaagagaaccuccugcccgauagcuuuguguguuucgagcacaaaggacaguacaaggguaccauggacuccggccaaacgaaacgagaacuuaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcagauccaagucagcggcguuuggaaaaagccacugugcgugggcuaugaacguguaguggucaaaagagaguugagugccaagcccauacagaggguggaaccuuguacaacuugcaucaccaaaugugagccacacgggcucguugugcggucuacaggauuuaagauuuccagcgcagucgccugcgcuucggguguguguguaaccggcucucagucccccucaacggagaucacucugaaguacccggggauuagucaaagcuccggaggcgauaucgguguucauauggcgcacgacgaucagucugugagcucaaaaauagucgcacauugcccuccccaggacccauguuuagugcacgauugcauugucugcgcccaugggcugaucaauuaucagugucacacagcucucagugccuucgugguuguguucguauuuuccagcauugcaaucaucugccuugccauucuguaccgcgucuugaagugucuaaaaauagcuccuagaaaggugcugaacccccucauguggaucaccgccuucauuagguggaucuauaaaaagaugguugcacggguggcggacaauauaaaccaagucaaucgcgaaauuggcuggauggagggaggccagcuggugcuugggaacccagcucccaucccucgacacgccccaaucccgagauacucuacuuaccugauguugcuccugauuguaucauaugcaagugccugcagcgaauuaauccaggcuuccucuaggauuacaaccuguucgacggagggagugaacaccaagugccggcugagcgguacagcccuaauacgugcaggcuccguuggggcugaagccugucucaugcugaaaggagucaaggaggaucagacuaaauuucuuaagaucaaaaccgugucaagugaguugucuugccgcgaaggccaaagcuacuggacagguuccuucucacccaagugucugagcucuagaaggugccaucucgugggggagugucacgucaaucggugccuguccuggcgagacaacgaaaccagugcggaguuuagcuucguuggcgaaucuacuacaaugcgcgagaauaaaugcuuugagcaguguggaggcugggggugcggauguuucaacgugaauccuuccugccuuuuugugcauaccuaucugcagucaguaagaaaggaagccuugagggucuucaacuguauugacugggugcacaagcucacucuggagaucacggauuuugacgguaguguuagcacaaucgauuuaggcgcuucguccucucgguucaccaauugggggagcgugucacugagucuagacgcagaaggaauuuccggcucuaacagcuuuuccuucauagagucaccagguaaaggguacgccaucgucgaugagcccuucagcgaaauuccucgccagggcuuucucggagagaucagaugcaauagugaaucuuccgugcugagcgcucacgagucgugucuuagggccccaaacuugauuucauauaagcccaugaucgaccaacuggaaugcacuaccaaucucauagauccguucguuguguuugagcguggcucucugccucagacacggaacgacaaaaccuucgcagcgaguaaggggaaucgaggaguacaggccuuuuccaaaggcagcguccaggcugauuuaacucugauguucgacaacuuugagguggauuucgugggugccgcagucucuugugacgcugccuuucuuaauuugacagggugcuacagcuguaacgcaggagccagaguuugccucuccaucacgucaaccggcacugguagucugagcgcucauaacaaggauggcucucuacacauugugcugccauccgaaaaugggacaaaggaccaaugccagauccuccauuucaccguacccgagguggaagaggaauuuauguauucaugugacggagaugagaggccucugcuugucaaaggcacauugauugcgaucgaccccuucgaugaccgccgggaggccgggggagaaaguacugugguuaacccaaagagcggcuccuggaacuuuuucgauugguucucuggucugaugucgugguuugggggaccuuuaaaaaccauacuccugauuugccuuuacguggcacugagcaucggcuuguucuuucuccugauuuaccuagguagaacgggccugucaaagauguggcucgcugccaccaaaaaggccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17383 - RNA, 3337 nt, Artificial Sequence
  mRNA product Design2 comprising derived and/or modified sequence from RVFV(ZH-548)__DQ380206.1__Gne_SP-Gn_Gc (opt3)
ggggcgcugccuacggagguggcagccaucuccuucucggcaucaagcuuaccauggccggcaucgcuaugaccgugcugcccgcacucgccgucuucgcgcuugcuccuguuguguuugccgaggacccacaccugagaaauaggccggggaagggacauaauuacauugaugguaugacacaggaagacgcaacuugcaaacccguaacguaugccggcgcuuguagcuccuucgauguguuguuagagaaggggaaauuuccucuguuccaaucuuacgcacaccaucggacccuacucgaagccguccacgacacaauaaucgcuaaggccgauccacccucaugcgaccugcuuagugcgcauggaaacccuuguaugaaagagaagcuggugaugaagacucacugcccaaaugauuaucagagcgcacacuacuugaacaaugacggcaaaauggccuccguuaagugucccccuaaauaugaacucaccgaggauugcaacuuuugucgccagaugacaggugcuucucugaagaaagggucguacccacugcaggaccucuucugccaaucaagcgaggaugacggaaguaaguuaaagaccaaaaugaagggcgugugugaagucggcgugcaggcccugaaaaagugcgaugggcagcuuuccacugcacaugagguaguuccguuugcuguguucaaaaauucuaagaaagucuauuuggacaagcuggaccuaaagacagaagagaaccuccugcccgauagcuuuguguguuucgagcacaaaggacaguacaaggguaccauggacuccggccaaacgaaacgagaacuuaagucauuugauauuagucagugcccuaaaaucgggggacauggcagcaagaagugcacuggugacgccgcguucuguucugccuacgagugcaccgcacaguaugcuaaugccuacuguucccacgcuaacgggucaggaauugugcagauccaagucagcggcguuuggaaaaagccacugugcgugggcuaugaacguguaguggucaaaagagaguugagugccaagcccauacagaggguggaaccuuguacaacuugcaucaccaaaugugagccacacgggcucguugugcggucuacaggauuuaagauuuccagcgcagucgccugcgcuucggguguguguguaaccggcucucagucccccucaacggagaucacucugaaguacccggggauuagucaaagcuccggaggcgauaucgguguucauauggcgcacgacgaucagucugugagcucaaaaauagucgcacauugcccuccccaggacccauguuuagugcacgauugcauugucugcgcccaugggcugaucaauuaucagugucacacagcuauggccggcauugcaaugaccgugcucccugcccuugcuguuuucgcccuggcacccgugguauucgcggaagacugcagugaguugauccaagcuagcagccgcaucacuacauguucuaccgaaggagucaacacgaagugcagacuaucaggcaccgcccugauuagggcagggagugugggagccgaggcuugucucaugcugaaagguguuaaggaagaucagacaaaauuucuuaagauaaagacugugagcuccgagcugucuugccgggagggccagucguacuggaccgggagcuucuccccaaaauguuugucaagucgccgaugccaccucgucggagaaugucaugugaauagaugccugucuuggagggacaacgagacaagcgccgaauuuuccuucguaggcgagucaacuaccaugcgggaaaauaaguguuuugagcagugcgguggguggggcugcggauguuucaacgugaaccccagcugcuuauuuguucacacauaucugcaaucuguccguaaagaggcacuacgcguguucaauuguaucgacugggugcauaagcucacccuggaaauuacugauuuugacggcuccgucaguacgaucgaucuuggggcuuccucuuccagauucacaaacuggggaucaguuaguuugagccuggacgccgaggguauaucgggcuccaauucuuuuagcuucauugaaucaccugggaaaggauacgcgaucguggaugagccauuuagugagaucccgaggcagggcuuccucggugaaauucggugcaacuccgagucuagcgugcuguccgcccacgaaucaugucuucgagcucccaaucugaucagcuacaagccuaugauugaccaguuggagugcaccacuaaccucauagauccauucguagucuuugaacgcgggagucugccccagaccagaaaugacaaaacauucgcagccucuaagggcaacaggggagugcaggcuuuuuccaagggcagcguucaagccgauuuaacccugauguucgacaauuuugagguggauuucgucggggcagcggugucgugugacgccgcuuuucuaaaccucacuggaugcuauucauguaaugccggcgcacggguuugccugucuaucacaaguacggguaccgggucccuuagcgcucacaacaaagauggaucuuugcauauugugcugccuagcgagaauggcacuaaggaccagugucagauccuccacuucacaguaccagaagucgaggaagaguuuauguacuccugcgacggugaugaacgcccccuguuagugaaaggcacccugaucgccauugacccguucgaugacagaagggaggcagggggagagucaacaguggucaacccuaagaguggcagcuggaacuuuuucgauugguuuucugggcuuauguccugguucggaggcccauugaaaacuauacuccugaucugccuauauguugcccugucaauuggucucuucuuucugcuuaucuacuuggggcguaccggacugaguaagaugugguuagcugcgacgaagaaagccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17384 - RNA, 3571 nt, Artificial Sequence
  mRNA product Design2 comprising derived and/or modified sequence from RVFV(ZH-548)__DQ380206.1__IgE-leader_Gn(delSP)-Gc-variant1 (opt3)
ggggcgcugccuacggagguggcagccaucuccuucucggcaucaagcuuaccauggacuggacauggauccuguuccucguggccgcugcaacaagaguccacagcgaggauccccaucuuaggaaccggccuggcaaggggcacaauuacauugacggaaugacucaggaagaugccacgugcaaaccaguuaccuaugcgggugcuuguuccucuuuugacgugcuguuggagaagggcaaauucccguuauuucaaucauacgcccaucaccgcacacugcuagaagcaguacaugauacuauaaucgccaaggcugaucccccuaguugcgaccuccugagcgcacacgggaacccauguaugaaagagaaacuugugaugaagacccacugccccaaugacuaucaguccgcccauuaccugaacaaugauggaaaaauggcuucugucaaguguccuccaaaauaugaauugacagaggacugcaacuucugucgacagaugaccggcgccucgcucaagaaagguucauacccccugcaggaucuguuuugccaaagcagugaggacgauggguccaagcucaagacuaaaaugaagggagugugugaaguuggcgugcaggcguuaaagaagugcgacggccagcugucuacagcacacgaggucgugccuuucgccguauuuaaaaauagcaagaaaguuuaucuugacaaguuggaucugaagaccgaagagaaccuacucccagacuccuucguguguuuugagcauaaagggcaguacaagggaacgauggauucaggucaaacuaaacgugaacugaagaguuucgacauuagccagugcccgaaaaucggcgggcacggaucuaagaagugcaccggcgaugcugccuuuuguuccgcauacgagugcacagcucaguaugccaaugcguacuguucacacgccaacgguagcgggauuguccagauccaagugaguggaguguggaaaaagccccuuugcgucggcuaugaaagaguugugguaaaaagggagcugucugcaaagccuauacagcggguggaaccauguacuaccugcaucacaaaaugugagccccauggcuuggucgugcgcuccaccggguucaagauuagcucggcuguugccugcgcuucuggagugugugucacggguucccagucaccuaguacugagaucacacucaaguacccaggcauuagccaauccucugggggagacaucggcgugcacauggcccaugaugaccagagcguaucaaguaaaauaguugcacacugucccccgcaggauccuugccuggugcaugacugcauugucugcgcccacgguuuaaucaauuaucagugucacaccgcucuguccgcguuuguggucguguucguuuucagcucuauugcaaucaucugccucgccauucuuuacagagugcugaaguguuugaaaauagcucccaggaagguacuaaacccacugauguggaucacugccuuuauucgguggaucuauaaaaagauggucgcacgcguggccgauaauauaaaccaaguuaaucgagaaauuggguggauggagggcggacagcucgugcugggcaacccugcucccaucccaagacaugcccccaucccuagguacucaacauaccuuaugcuguugcucauugucaguuaugcaagcgcgugcuccgaacugauccaggcuucuucgcggauuaccacguguagcaccgagggggugaacacaaagugccguuuauccggaacugcccugauacgcgcagguucaguaggcgccgaggcuugucuaaugcucaaaggggugaaggaagaccagaccaaauuccugaagaucaaaacaguuaguucugagcuuagcugcagagaaggacaauccuacuggacuggcucauuuagcccaaaguguuugucuuccaggcggugccaccuggucggugagugucaugugaaucgaugccucaguuggcgcgacaacgaaaccagcgccgaguucucuuuugugggggaauccacaaccaugagagagaauaaaugcuucgagcaguguggcggauggggcugcggguguuuuaacgucaauccgucaugccuguucguucacacuuaucuucagagugugaggaaggaagcacugcggguguuuaacuguauugauuggguacacaaguugacgcucgagaucacagacuucgauggaagcgucucgaccaucgaccugggugcuuccucuagccgcuuuacuaauuggggcucagugaguuuaucccuggaugccgaagggauuucuggaagcaacuccuucucauuuauagagagccccggcaaagguuacgcgaucguugacgagccuuucagugaaauuccaagacagggguuccuaggcgagaucaggugcaauucugaauccagcgugcucucggcccaugagucaugucugcgugcucccaaccuuauuucuuauaagccuaugaucgaucaauuggaaugcaccacaaaucugauagacccauuugucguguucgagcggggaagucucccccagacccgaaacgauaaaacuuuugcagccuccaagggcaauagagggguucaggcuuucagcaaaggaucugugcaggccgaccugacauuaauguuugauaacuucgagguagacuuugucggcgcagcggugagcugugaugccgcuuuccugaaucuuacggguugcuacuccuguaacgccggggcaagggugugcuugucaaucaccaguacuggaacaggcagccucucugcucacaacaaggacgguucccugcauauuguccuaccgucagaaaauggcaccaaggaccaaugccagauccugcacuuuacaguuccugagguggaagaggaguucauguauaguugugauggggacgaacgcccacuccugguaaaaggaacucuuauugccaucgaucccuuugacgaucggagagaggcaggcggggaaagcaccguggucaacccuaaguccggaucuuggaauuucuuugacugguucucgggcuugaugagcugguucggugggccccugaaaacgauauuacucauuugccuguacguggcccuuucaaucggacuguuuuucuugcucauuuaccugggcaggaccggucuauccaagauguggcuggcugcgaccaaaaaggccaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17385 - RNA, 3565 nt, Artificial Sequence
  mRNA product Design2 comprising derived and/or modified sequence from RVFV(ZH-548)__DQ380206.1__IgE-leader_Gn(delSP)-Gc-variant2 (opt3)
ggggcgcugccuacggagguggcagccaucuccuucucggcaucaagcuuaccauggacuggacauggauccuguuccucguggccgcugcaacaagaguccacagcccccaucuuaggaaccggccuggcaaggggcacaauuacauugauggaaugacucaggaggacgccacgugcaaaccaguuaccuaugcgggugcuuguuccucuuuugaugugcuguuggaaaagggcaaauucccguuauuucaaucauacgcccaucaccgcacacugcuagaggcaguacaugacacuauaaucgccaaggcugaucccccuaguugcgaccuccugagcgcacacgggaacccauguaugaaagaaaaacuugugaugaagacccacugccccaaugauuaucaguccgcccauuaccugaacaaugacggaaaaauggcuucugucaaguguccuccaaaauaugaguugacagaagauugcaacuucugucgacagaugaccggcgccucgcucaagaaagguucauacccccugcaggaccuguuuugccaaagcagugaggaugacggguccaagcucaagacuaaaaugaagggagugugugagguuggcgugcaggcguuaaagaagugcgauggccagcugucuacagcacacgaagucgugccuuucgccguauuuaaaaauagcaagaaaguuuaucuugacaaguuggaccugaagaccgaggaaaaccuacucccagauuccuucguguguuuugagcauaaagggcaguacaagggaacgauggacucaggucaaacuaaacgugagcugaagaguuucgauauuagccagugcccgaaaaucggcgggcacggaucuaagaagugcaccggcgacgcugccuuuuguuccgcauacgaaugcacagcucaguaugccaaugcguacuguucacacgccaacgguagcgggauuguccagauccaagugaguggaguguggaaaaagccccuuugcgucggcuaugagagaguugugguaaaaagggaacugucugcaaagccuauacagcggguggagccauguacuaccugcaucacaaaaugugaaccccauggcuuggucgugcgcuccaccggguucaagauuagcucggcuguugccugcgcuucuggagugugugucacggguucccagucaccuaguacugagaucacacucaaguacccaggcauuagccaauccucugggggagauaucggcgugcacauggcccaugacgaucagagcguaucaaguaaaauaguugcacacugucccccgcaggacccuugccuggugcaugauugcauugucugcgcccacgguuuaaucaauuaucagugucacaccgcucuguccgcguuuguggucguguucguuuucagcucuauugcaaucaucugccucgccauucuuuacagagugcugaaguguuugaaaauagcucccaggaagguacuaaacccacugauguggaucacugccuuuauucgguggaucuauaaaaagauggucgcacgcguggccgacaauauaaaccaaguuaaucgagagauuggguggauggaaggcggacagcucgugcugggcaacccugcucccaucccaagacaugcccccaucccuagguacucaacauaccuuaugcuguugcucauugucaguuaugcaagcgcgugcuccgagcugauccaggcuucuucgcggauuaccacguguagcaccgaaggggugaacacaaagugccguuuauccggaacugcccugauacgcgcagguucaguaggcgccgaggcuugucuaaugcucaaaggggugaaggaagaucagaccaaauuccugaagaucaaaacaguuaguucugagcuuagcugcagagagggacaauccuacuggacuggcucauuuagcccaaaguguuugucuuccaggcggugccaccuggucggugaaugucaugugaaucgaugccucaguuggcgcgacaacgagaccagcgccgaguucucuuuugugggggaauccacaaccaugagagaaaauaaaugcuucgagcaguguggcggauggggcugcggguguuuuaacgucaauccgucaugccuguucguucacacuuaucuucagagugugaggaaggaggcacugcggguguuuaacuguauugacuggguacacaaguugacgcucgaaaucacagauuucgacggaagcgucucgaccaucgaucugggugcuuccucuagccgcuuuacuaauuggggcucagugaguuuaucccuggacgccgaggggauuucuggaagcaacuccuucucauuuauagaaagccccggcaaagguuacgcgaucguugaugagccuuucagugagauuccaagacagggguuccuaggcgaaaucaggugcaauucugaguccagcgugcucucggcccaugaaucaugucugcgugcucccaaccuuauuucuuauaagccuaugaucgaccaauuggagugcaccacaaaucugauagauccauuugucguguucgaacggggaagucucccccagacccgaaacgacaaaacuuuugcagccuccaagggcaauagagggguucaggcuuucagcaaaggaucugugcaggccgaucugacauuaauguuugacaacuucgagguagauuuugucggcgcagcggugagcugugacgccgcuuuccugaaucuuacggguugcuacuccuguaacgccggggcaagggugugcuugucaaucaccaguacuggaacaggcagccucucugcucacaacaaggaugguucccugcauauuguccuaccgucagagaauggcaccaaggaccaaugccagauccugcacuuuacaguuccugaaguggaggaagaguucauguauaguugugacggggaugaacgcccacuccugguaaaaggaacucuuauugccaucgaccccuuugaugaccggagagaggcaggcggggagagcaccguggucaacccuaaguccggaucuuggaauuucuuugauugguucucgggcuugaugagcugguucggugggccccugaaaacgauauuacucauuugccuguacguggcccuuucaaucggacuguuuuucuugcucauuuaccugggcaggaccggucuauccaagauguggcuggcugcgaccaaaaaggccaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17386 - RNA, 2050 nt, Artificial Sequence
  mRNA product Design2 comprising derived and/or modified sequence from RVFV(ZH-548)__DQ380206.1__IgE-leader_Gn(delSP)-variant1 (opt3)
ggggcgcugccuacggagguggcagccaucuccuucucggcaucaagcuuaccauggacuggaccuggauccuguuccucguggccgcugcaacaagaguccacagcgaggauccccaucuuaggaaccggccuggcaaggggcacaauuacauugacggaaugacucaggaagaugccacgugcaaaccaguuaccuaugcgggugcuuguuccucuuuugacgugcuguuggagaagggcaaauucccguuauuucaaucauacgcccaucaccgcacacugcuagaagcaguacaugauacuauaaucgccaaggcugaucccccuaguugcgaccuccugagcgcacacgggaacccauguaugaaagagaaacuugugaugaagacccacugccccaaugacuaucaguccgcccauuaccugaacaaugauggaaaaauggcuucugucaaguguccuccaaaauaugaauugacagaggacugcaacuucugucgacagaugaccggcgccucgcucaagaaagguucauacccccugcaggaucuguuuugccaaagcagugaggacgauggguccaagcucaagacuaaaaugaagggagugugugaaguuggcgugcaggcguuaaagaagugcgacggccagcugucuacagcacacgaggucgugccuuucgccguauuuaaaaauagcaagaaaguuuaucuugacaaguuggaucugaagaccgaagagaaccuacucccagacuccuucguguguuuugagcauaaagggcaguacaagggaacgauggauucaggucaaacuaaacgugaacugaagaguuucgacauuagccagugcccgaaaaucggcgggcacggaucuaagaagugcaccggcgaugcugccuuuuguuccgcauacgagugcacagcucaguaugccaaugcguacuguucacacgccaacgguagcgggauuguccagauccaagugaguggaguguggaaaaagccccuuugcgucggcuaugaaagaguugugguaaaaagggagcugucugcaaagccuauacagcggguggaaccauguacuaccugcaucacaaaaugugagccccauggcuuggucgugcgcuccaccggguucaagauuagcucggcuguugccugcgcuucuggagugugugucacggguucccagucaccuaguacugagaucacacucaaguacccaggcauuagccaauccucugggggagacaucggcgugcacauggcccaugaugaccagagcguaucaaguaaaauaguugcacacugucccccgcaggauccuugccuggugcaugacugcauugucugcgcccacgguuuaaucaauuaucagugucacaccgcucuguccgcguuuguggucguguucguuuucagcucuauugcaaucaucugccucgccauucuuuacagagugcugaaguguuugaaaauagcucccaggaagguacuaaacccacugauguggaucacugccuuuauucgguggaucuauaaaaagauggucgcacgcguggccgauaauauaaaccaaguuaaucgagaaauuggguggauggagggcggacagcucgugcugggcaacccugcucccaucccaagacaugcccccaucccuagguacucaacauaccuuaugcuguugcucauugucaguuaugcaagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17387 - RNA, 2044 nt, Artificial Sequence
  mRNA product Design2 comprising derived and/or modified sequence from RVFV(ZH-548)__DQ380206.1__IgE-leader_Gn(delSP)-variant2 (opt3)
ggggcgcugccuacggagguggcagccaucuccuucucggcaucaagcuuaccauggacuggaccuggauccuguuccucguggccgcugcaacaagaguccacagcccccaucuuaggaaccggccuggcaaggggcacaauuacauugauggaaugacucaggaggacgccacgugcaaaccaguuaccuaugcgggugcuuguuccucuuuugaugugcuguuggaaaagggcaaauucccguuauuucaaucauacgcccaucaccgcacacugcuagaggcaguacaugacacuauaaucgccaaggcugaucccccuaguugcgaccuccugagcgcacacgggaacccauguaugaaagaaaaacuugugaugaagacccacugccccaaugauuaucaguccgcccauuaccugaacaaugacggaaaaauggcuucugucaaguguccuccaaaauaugaguugacagaagauugcaacuucugucgacagaugaccggcgccucgcucaagaaagguucauacccccugcaggaccuguuuugccaaagcagugaggaugacggguccaagcucaagacuaaaaugaagggagugugugagguuggcgugcaggcguuaaagaagugcgauggccagcugucuacagcacacgaagucgugccuuucgccguauuuaaaaauagcaagaaaguuuaucuugacaaguuggaccugaagaccgaggaaaaccuacucccagauuccuucguguguuuugagcauaaagggcaguacaagggaacgauggacucaggucaaacuaaacgugagcugaagaguuucgauauuagccagugcccgaaaaucggcgggcacggaucuaagaagugcaccggcgacgcugccuuuuguuccgcauacgaaugcacagcucaguaugccaaugcguacuguucacacgccaacgguagcgggauuguccagauccaagugaguggaguguggaaaaagccccuuugcgucggcuaugagagaguugugguaaaaagggaacugucugcaaagccuauacagcggguggagccauguacuaccugcaucacaaaaugugaaccccauggcuuggucgugcgcuccaccggguucaagauuagcucggcuguugccugcgcuucuggagugugugucacggguucccagucaccuaguacugagaucacacucaaguacccaggcauuagccaauccucugggggagauaucggcgugcacauggcccaugacgaucagagcguaucaaguaaaauaguugcacacugucccccgcaggacccuugccuggugcaugauugcauugucugcgcccacgguuuaaucaauuaucagugucacaccgcucuguccgcguuuguggucguguucguuuucagcucuauugcaaucaucugccucgccauucuuuacagagugcugaaguguuugaaaauagcucccaggaagguacuaaacccacugauguggaucacugccuuuauucgguggaucuauaaaaagauggucgcacgcguggccgacaauauaaaccaaguuaaucgagagauuggguggauggaaggcggacagcucgugcugggcaacccugcucccaucccaagacaugcccccaucccuagguacucaacauaccuuaugcuguugcucauugucaguuaugcaagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17388 - RNA, 1960 nt, Artificial Sequence
  mRNA product Design2 comprising derived and/or modified sequence from RVFV(ZH-548)__DQ380206.1__IgE-leader_Gc (opt3)
ggggcgcugccuacggagguggcagccaucuccuucucggcaucaagcuuaccauggacuggaccuggauccuguuccucguggccgcugcaacaagaguccacagcugcuccgagcuuauucaggccucuucaaggauaacuacguguaguaccgaaggcguuaauacaaagugccggcugagcgggacugcguugauccgcgcuggauccgugggugccgaggcauguuuaaugcugaaaggcguaaaggaagaucaaaccaaauuucuaaagauuaaaacagugucuucggagcucucaugccgagaagggcagagcuacuggaccggaaguuucucccccaagugucugucuagccguagaugccaucuugucggcgagugucacgugaauaggugccuguccuggcgggacaacgagacuucagccgaauuuaguuucguuggugagagcacaaccaugcgcgaaaauaaguguuuugagcagugcgggggauggggcuguggcugcuucaacgugaauccuucuugcuuguuuguccauacguaucuccaguccgugagaaaagaggcucugaggguauucaacuguaucgauuggguucacaagcugacucucgaaauuaccgacuuugaugggucagugagcacaaucgacuuaggagcaaguucuucccgguucacuaauugggguagcgucucgcugucucuugaugccgagggcauauccgggucaaacaguuuuagcuucaucgaauccccaggaaaaggcuacgcuauuguggacgagccguuuucugaaaucccccgccaagguuucuugggggagauucgaugcaauagcgagucaagugugcuguccgcccaugaaagcugucuaagagcgccuaaccucaucucuuauaagccaaugauagaucagcuggagugcaccacaaaucuuauugaccccuucgucguuuuugaaaggggaucacugccucagacccggaacgauaaaacguucgcagccaguaagggcaaucguggcgugcaggcuuuuagcaagggguccguacaagccgacuugacucucauguucgauaacuuugagguggacuucgucggagcagcugugucuugugacgccgcguuucugaauuuaacagguugcuacucguguaacgccggcgcacgcguuugccugagcaucaccuccacugggacaggaucacucagugcucacaacaaagauggcucucuucacauugugcugccaagcgaaaaugguaccaaggaccagugucagaucuugcauuucacgguccccgagguggaggaagaguuuauguauuccugcgauggggacgaaagaccucuacugguaaaaggcacccucaucgccauugauccauucgacgauaggcgggaggcuggaggcgaaucaacaguugugaacccgaaaagcgggucuuggaacuuuuucgacugguuuuccggacugaugaguugguucgguggcccccuuaaaacuauacuguugaucugucucuacgucgcccugagcauuggguuauucuuucugcuaaucuaucucggacgaaccggccugucuaagauguggcuugcagccacaaagaaggcuuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17389 - RNA, 1120 nt, Artificial Sequence
  mRNA product Design2 comprising derived and/or modified sequence from RVFV(ZH-548)__DQ380151.1__N (opt1)
ggggcgcugccuacggagguggcagccaucuccuucucggcaucaagcuuaccauggacaacuaccaggagcuggccauccaguucgccgcgcaggccguggaccgcaacgagaucgagcaguggguccgggaguucgccuaccagggcuucgacgcccgccgggugaucgagcuccugaagcaguacgggggcgccgacugggagaaggacgcgaagaagaugaucgugcuggcccucacccgcgggaacaagccccggcgcaugaugaugaagaugagcaaggagggcaaggccaccgucgaggcccugaucaacaaguacaagcugaaggaggggaacccgucccgggacgagcucacgcugagccgcguggcggccgcccuggccggcuggaccugccaggcccucgugguccuguccgaguggcugcccgugaccggcaccacgauggacgggcucagccccgcguacccccggcacaugaugcacccguccuucgccggcaugguggaccccagccugcccggggacuaccugcgcgccauccucgacgcccacucccuguaccugcuccaguucagccgggucaucaaccccaaccugcgcggccggaccaaggaggagguggccgcgaccuucacccagccgaugaacgccgccgugaacuccaacuucaucagccacgagaagcgccgggaguuccugaaggccuucgggcucgucgacuccaacggcaagcccagcgccgcggugauggccgccgcccaggccuacaagacggcggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17390 - RNA, 3976 nt, Artificial Sequence
  mRNA product Design2 comprising derived and/or modified sequence from RVFV(ZH-548)__DQ380206.1__GP (opt1) R6110
ggggcgcugccuacggagguggcagccaucuccuucucggcaucaagcuuaccauguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17391 - RNA, 3586 nt, Artificial Sequence
  mRNA product Design2 comprising derived and/or modified sequence from RVFV(ZH-548)__DQ380206.1__Gn-Gc (opt1) R6111
ggggcgcugccuacggagguggcagccaucuccuucucggcaucaagcuuaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17392 - RNA, 3337 nt, Artificial Sequence
  mRNA product Design2 comprising derived and/or modified sequence from RVFV(ZH-548)__DQ380206.1__Gne_SP-Gn_Gc (opt1) R6115
ggggcgcugccuacggagguggcagccaucuccuucucggcaucaagcuuaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggccauggcggggaucgccaugaccgugcugcccgcccuggccguguucgcgcucgcccccgucguguucgccgaggacugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17393 - RNA, 3571 nt, Artificial Sequence
  mRNA product Design2 comprising derived and/or modified sequence from RVFV(ZH-548)__DQ380206.1__IgE-leader_Gn(delSP)-Gc-variant1 (opt1) R6164
ggggcgcugccuacggagguggcagccaucuccuucucggcaucaagcuuaccauggacuggaccuggauccuguuccucguggccgccgcgacccgcguccacagcgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17394 - RNA, 3565 nt, Artificial Sequence
  mRNA product Design2 comprising derived and/or modified sequence from RVFV(ZH-548)__DQ380206.1__IgE-leader_Gn(delSP)-Gc-variant2 (opt1) R6112
ggggcgcugccuacggagguggcagccaucuccuucucggcaucaagcuuaccauggacuggaccuggauccuguuccucguggccgccgcgacccgcguccacagcccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17395 - RNA, 2050 nt, Artificial Sequence
  mRNA product Design2 comprising derived and/or modified sequence from RVFV(ZH-548)__DQ380206.1__IgE-leader_Gn(delSP)-variant1 (opt1) R6165
ggggcgcugccuacggagguggcagccaucuccuucucggcaucaagcuuaccauggacuggaccuggauccuguuccucguggccgccgcgacccgcguccacagcgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17396 - RNA, 2044 nt, Artificial Sequence
  mRNA product Design2 comprising derived and/or modified sequence from RVFV(ZH-548)__DQ380206.1__IgE-leader_Gn(delSP)-variant2 (opt1) R6113
ggggcgcugccuacggagguggcagccaucuccuucucggcaucaagcuuaccauggacuggaccuggauccuguuccucguggccgccgcgacccgcguccacagcccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17397 - RNA, 1960 nt, Artificial Sequence
  mRNA product Design2 comprising derived and/or modified sequence from RVFV(ZH-548)__DQ380206.1__IgE-leader_Gc (opt1) R6114
ggggcgcugccuacggagguggcagccaucuccuucucggcaucaagcuuaccauggacuggaccuggauccuguuccucguggccgccgcgacccgcguccacagcugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17398 - RNA, 1120 nt, Artificial Sequence; identical to SEQ ID NO: 17389
  mRNA product Design2 comprising derived and/or modified sequence from RVFV(ZH-548)__DQ380151.1__N (opt1)

SEQ ID NO: 17399 - RNA, 3976 nt, Artificial Sequence; identical to SEQ ID NO: 17390
  mRNA product Design2 comprising derived and/or modified sequence from RVFV(ZH-548)__DQ380206.1__GP (opt1)

SEQ ID NO: 17400 - RNA, 3586 nt, Artificial Sequence
  mRNA product Design2 comprising derived and/or modified sequence from RVFV(ZH-548)__DQ380206.1__Gn-Gc (opt1)
ggggcgcugccuacggagguggcagccaucuccuucucggcaucaagcuuaccauggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcucagcgcccacggcaaccccugcaugaaggagaagcuggucaugaagacgcacugccccaacgacuaccaguccgcccacuaccugaacaacgacggcaagauggcgagcgugaagugcccgcccaaguacgagcucaccgaggacugcaacuucugccggcagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacgcugaaguacccggggaucagccaguccagcggcggggacaucggcguccacauggcccacgacgaccaguccgugagcuccaagaucguggcccacugcccgccccaggaccccugccugguccacgacugcaucgugugcgcccacggccucaucaacuaccagugccacaccgcgcugagcgccuucguggucguguucguguucuccagcaucgccaucaucugccuggccauccucuaccggguccugaagugccugaagaucgcgccccgcaaggugcucaacccccugauguggaucaccgccuucauccgguggaucuacaagaagaugguggcccgcgucgccgacaacaucaaccaggugaaccgggagaucggguggauggagggcgggcagcuggugcucggcaaccccgcccccaucccgcgccacgcccccaucccccgguacuccaccuaccugaugcugcuccugaucgucagcuacgcgagcgccugcuccgagcugauccaggccagcucccgcaucacgaccugcagcaccgagggggugaacaccaagugccggcucuccggcacggcccugauccgcgccggcagcgugggggcggaggccugccugaugcucaagggcgucaaggaggaccagaccaaguuccugaagaucaagaccguguccagcgagcuguccugccgggaggggcagagcuacuggaccggcuccuucagcccgaagugccuguccagccgccggugccaccucgugggcgagugccacgucaaccgcugccuguccuggcgcgacaacgagacgagcgccgaguucuccuucgugggggagagcaccaccaugcgggagaacaagugcuucgagcagugcggcggguggggcugcgggugcuucaacgugaaccccagcugccuguucguccacaccuaccuccaguccgugcgcaaggaggcccugcggguguucaacugcaucgacuggguccacaagcugacgcucgagaucaccgacuucgacggcagcguguccaccaucgaccugggcgcgagcuccagccgcuucaccaacuggggguccgugagccugucccucgacgccgagggcaucagcggguccaacagcuucuccuucaucgagagccccggcaagggguacgccaucgucgacgagcccuucuccgagaucccgcggcagggcuuccugggcgagauccgcugcaacagcgaguccagcgugcuguccgcccacgagagcugccuccgggcccccaaccugaucagcuacaagcccaugaucgaccagcuggagugcaccacgaaccucaucgaccccuucguggucuucgagcgcgggucccugccgcagacccggaacgacaagaccuucgcggccagcaagggcaaccgcggggugcaggccuucuccaagggcagcgugcaggccgaccugacccucauguucgacaacuucgaggucgacuucgugggggccgcgguguccugcgacgccgccuuccugaaccugacgggcugcuacagcugcaacgccggcgcccgggucugccucuccaucaccagcaccgggaccggcucccugagcgcgcacaacaaggacgggucccugcacaucgugcuccccagcgagaacggcacgaaggaccagugccagauccugcacuucaccgugcccgaggucgaggaggaguucauguacuccugcgacggggacgagcgcccccugcucgugaagggcacccugaucgccaucgacccguucgacgaccggcgcgaggccggcggggagagcaccguggucaaccccaaguccggcagcuggaacuucuucgacugguucuccgggcugaugagcugguucggcggcccccucaagacgauccugcugaucugccucuacguggcccuguccaucgggcuguucuuccuccugaucuaccugggccggaccgggcucagcaagauguggcuggcggccaccaagaaggccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17401 - RNA, 3337 nt, Artificial Sequence
  mRNA product Design2 comprising derived and/or modified sequence from RVFV(ZH-548)__DQ380206.1__Gne_SP-Gn_Gc (opt1)
ggggcgcugccuacggagguggcagccaucuccuucucggcaucaagcuuaccauggccggcaucgccaugaccgugcugcccgcgcucgccgucuucgcccuggccccggugguguucgccgaggacccccaccuccgcaaccggcccgggaagggccacaacuacaucgacgggaugacccaggaggacgcgacgugcaagcccgucaccuacgccggcgccugcagcuccuucgacgugcugcuggagaaggggaaguucccgcuguuccagagcuacgcccaccaccgcacccuccuggaggcggugcacgacaccaucaucgccaaggccgacccgcccuccugcgaccugcucagcgcccacggcaaccccugcaugaaggagaagcuggucaugaagacgcacugccccaacgacuaccaguccgcccacuaccugaacaacgacggcaagauggcgagcgugaagugcccgcccaaguacgagcucaccgaggacugcaacuucugccggcagaugaccggggccucccugaagaagggcagcuacccccugcaggaccucuucugccaguccagcgaggacgacggguccaagcugaagaccaagaugaagggcgugugcgaggucggggugcaggcccugaagaagugcgacggccagcucagcacggcccacgaggugguccccuucgccguguucaagaacuccaagaagguguaccuggacaagcuggaccucaagaccgaggagaaccugcugcccgacagcuucgucugcuucgagcacaagggccaguacaaggggaccauggacuccggccagaccaagcgcgagcucaagagcuucgacaucucccagugccccaagaucgggggccacggcagcaagaagugcacgggggacgcggccuucugcuccgccuacgagugcaccgcccaguacgccaacgcguacugcagccacgccaacggcagcgggaucgugcagauccagguguccggcgucuggaagaagccccugugcgugggguacgagcggguggucgugaagcgcgagcugagcgccaagccgauccagcggguggagcccugcacgaccugcaucaccaagugcgagccccacggccucgucgugcgcuccaccggcuucaagaucagcuccgccgucgccugcgcgagcggggugugcgugaccggcucccagagccccuccaccgagaucacgcugaaguacccggggaucagccaguccagcggcggggacaucggcguccacauggcccacgacgaccaguccgugagcuccaagaucguggcccacugcccgccccaggaccccugccugguccacgacugcaucgugugcgcccacggccucaucaacuaccagugccacaccgcgauggccgggaucgccaugaccgugcugcccgcccuggccgucuucgcgcucgcccccgugguguucgccgaggacugcagcgagcugauccaggccuccagccggaucaccacgugcuccaccgagggcgucaacaccaagugccgccugagcgggaccgcccucauccgggcgggcagcgugggggccgaggccugccugaugcugaagggcgugaaggaggaccagacgaaguuccucaagaucaagaccgucuccagcgagcuguccugccgcgagggccagagcuacuggaccggguccuucagccccaagugccuguccagccggcgcugccaccucgugggcgagugccacgugaaccggugccuguccuggcgcgacaacgagaccagcgccgaguucuccuucgucggggagagcacgaccaugcgggagaacaagugcuucgagcagugcggcggcugggggugcggcugcuucaacgugaaccccuccugccuguucgugcacaccuaccuccagagcguccgcaaggaggcccugcggguguucaacugcaucgacugggugcacaagcugacccucgagaucacggacuucgacggguccgucagcaccaucgaccugggcgcguccagcagccgcuucaccaacuggggguccgugagccugucccuggacgccgagggcaucagcggcuccaacagcuucuccuucaucgagagcccggggaagggcuacgccaucguggacgagcccuucuccgagaucccccggcagggguuccucggcgagauccgcugcaacagcgaguccagcguccuguccgcccacgagagcugccugcgcgcgccgaaccucaucuccuacaagcccaugaucgaccagcuggagugcaccaccaaccugaucgaccccuucgugguguucgagcgggggagccucccccagacgcgcaacgacaagaccuucgccgccuccaagggcaaccggggcguccaggccuucagcaagggguccgugcaggccgaccugacccugauguucgacaacuucgagguggacuucgucggcgcggccgugagcugcgacgccgccuuccucaaccugaccgggugcuacagcugcaacgccggcgcgcgcgugugccuguccaucacgagcaccgggaccggcucccucagcgcccacaacaaggacggcucccugcacaucguccugccgagcgagaacgggaccaaggaccagugccagauccuccacuucacggugcccgagguggaggaggaguucauguacuccugcgacggcgacgagcggccccugcuggucaaggggacccucaucgccaucgaccccuucgacgaccgccgggaggccggcggggagagcaccguggugaacccgaaguccggcagcuggaacuucuucgacugguucuccggccugaugagcugguucgggggcccccugaagaccauccuccugaucugccuguacgucgcccucuccaucgggcuguucuuccugcucaucuaccugggccgcacgggccugagcaagauguggcucgcggccaccaagaaggccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17402 - RNA, 3571 nt, Artificial Sequence
  mRNA product Design2 comprising derived and/or modified sequence from RVFV(ZH-548)__DQ380206.1__IgE-leader_Gn(delSP)-Gc-variant1 (opt1)
ggggcgcugccuacggagguggcagccaucuccuucucggcaucaagcuuaccauggacuggaccuggauccuguuccucguggccgccgcgacccgcguccacagcgaggacccccaccuccggaaccgcccgggcaaggggcacaacuacaucgacggcaugacgcaggaggacgcgaccugcaagcccgugaccuacgccggggccugcuccagcuucgacgugcugcuggagaagggcaaguucccccuguuccaguccuacgcccaccaccggacccugcucgaggccguccacgacacgaucaucgccaaggccgacccgcccagcugcgaccugcuguccgcccacgggaaccccugcaugaaggagaagcucgugaugaagacccacugccccaacgacuaccagagcgcgcacuaccugaacaacgacggcaagauggccuccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagacgaagaugaagggggucugcgaggugggcgugcaggcccugaagaagugcgacgggcagcuguccaccgcccacgaggucgugcccuucgcgguguucaagaacagcaagaaggucuaccucgacaagcuggaccugaagaccgaggagaaccuccugcccgacuccuucgugugcuucgagcacaagggccaguacaagggcaccauggacagcgggcagacgaagcgggagcugaaguccuucgacaucagccagugcccgaagaucggcgggcacggcuccaagaagugcaccggcgacgccgccuucugcagcgccuacgagugcaccgcccaguacgcgaacgccuacugcagccacgccaacggguccggcaucgugcagauccaggucagcgggguguggaagaagccccucugcgugggcuacgagcgcgucguggugaagcgggagcuguccgccaagcccauccagcgcgucgagcccugcaccacgugcaucaccaagugcgagccgcacgggcugguggugcggagcaccggcuucaagaucuccagcgccgucgcgugcgccuccggcgugugcgucaccgggagccagucccccagcacggagaucacccucaaguaccccggcaucucccagagcuccgggggcgacaucggggugcacauggcccacgacgaccagagcguguccagcaagaucgucgcccacugcccgccccaggaccccugccuggugcacgacugcaucgugugcgcccacggccugaucaacuaccagugccacaccgcgcucuccgccuucgucgugguguucgucuucagcuccaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaacccggcccccaucccccggcacgcgcccaucccgcgcuacagcacguaccucaugcugcugcucaucgugagcuacgccuccgccugcagcgagcugauccaggccuccagccggaucacgaccugcuccaccgagggcgugaacaccaagugccgccugagcgggaccgcccucauccgggcgggcuccgucggcgccgaggccugccugaugcugaagggggugaaggaggaccagaccaaguuccucaagaucaagaccgugagcuccgagcugagcugccgcgagggccaguccuacuggacggggagcuucucccccaagugccugagcucccggcgcugccaccuggucggcgagugccacgugaaccgcugccucagcuggcgggacaacgagaccuccgccgaguucagcuucgugggcgagagcaccaccaugcgcgagaacaagugcuucgagcagugcgggggcugggggugcggcugcuucaacgucaaccccuccugccuguucgugcacacguaccugcagagcgugcggaaggaggcccuccgcgucuucaacugcaucgacugggugcacaagcugacccuggagaucaccgacuucgacggguccgugagcaccaucgaccucggcgcguccagcucccgguucaccaacuggggcagcgucucccugagccuggacgccgaggggaucuccggcagcaacuccuucagcuucaucgaguccccggggaagggcuacgccaucguggacgagcccuucagcgagaucccccgccagggguuccucggcgagauccggugcaacuccgagagcuccgugcugagcgcccacgagagcugccugcgcgcgcccaaccucaucuccuacaagccgaugaucgaccagcuggagugcacgaccaaccugaucgaccccuucgucguguucgagcggggcagccucccccagacccgcaacgacaagaccuucgccgccuccaaggggaaccggggcgugcaggccuucagcaagggguccguccaggccgaccugacgcugauguucgacaacuucgagguggacuucgugggcgcggccgucagcugcgacgccgccuuccucaaccugaccgggugcuacuccugcaacgccggcgcgcgcgugugccugagcaucaccuccaccggcacggggagccucuccgcccacaacaaggacggcagccugcacaucgugcugcccuccgagaacgggaccaaggaccagugccagauccuccacuucaccgucccggagguggaggaggaguucauguacagcugcgacggcgacgagcggccccugcuggugaaggggacccucaucgccaucgaccccuucgacgaccgccgggaggccggcggcgaguccacggucgugaaccccaagagcggguccuggaacuucuucgacugguucagcggccugauguccugguucgggggcccgcugaagaccauccuccugaucugccuguacguggcccucagcaucggccuguucuuccugcucaucuaccuggggcgcaccggccugagcaagauguggcucgcggccaccaagaaggccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17403 - RNA, 3565 nt, Artificial Sequence
  mRNA product Design2 comprising derived and/or modified sequence from RVFV(ZH-548)__DQ380206.1__IgE-leader_Gn(delSP)-Gc-variant2 (opt1)
ggggcgcugccuacggagguggcagccaucuccuucucggcaucaagcuuaccauggacuggaccuggauccuguuccucguggccgccgcgacccgcguccacagcccccaccuccggaaccgcccgggcaaggggcacaacuacaucgacggcaugacgcaggaggacgcgaccugcaagcccgugaccuacgccggggccugcuccagcuucgacgugcugcuggagaagggcaaguucccccuguuccaguccuacgcccaccaccggacccugcucgaggccguccacgacacgaucaucgccaaggccgacccgcccagcugcgaccugcuguccgcccacgggaaccccugcaugaaggagaagcucgugaugaagacccacugccccaacgacuaccagagcgcgcacuaccugaacaacgacggcaagauggccuccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagacgaagaugaagggggucugcgaggugggcgugcaggcccugaagaagugcgacgggcagcuguccaccgcccacgaggucgugcccuucgcgguguucaagaacagcaagaaggucuaccucgacaagcuggaccugaagaccgaggagaaccuccugcccgacuccuucgugugcuucgagcacaagggccaguacaagggcaccauggacagcgggcagacgaagcgggagcugaaguccuucgacaucagccagugcccgaagaucggcgggcacggcuccaagaagugcaccggcgacgccgccuucugcagcgccuacgagugcaccgcccaguacgcgaacgccuacugcagccacgccaacggguccggcaucgugcagauccaggucagcgggguguggaagaagccccucugcgugggcuacgagcgcgucguggugaagcgggagcuguccgccaagcccauccagcgcgucgagcccugcaccacgugcaucaccaagugcgagccgcacgggcugguggugcggagcaccggcuucaagaucuccagcgccgucgcgugcgccuccggcgugugcgucaccgggagccagucccccagcacggagaucacccucaaguaccccggcaucucccagagcuccgggggcgacaucggggugcacauggcccacgacgaccagagcguguccagcaagaucgucgcccacugcccgccccaggaccccugccuggugcacgacugcaucgugugcgcccacggccugaucaacuaccagugccacaccgcgcucuccgccuucgucgugguguucgucuucagcuccaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaacccggcccccaucccccggcacgcgcccaucccgcgcuacagcacguaccucaugcugcugcucaucgugagcuacgccuccgccugcagcgagcugauccaggccuccagccggaucacgaccugcuccaccgagggcgugaacaccaagugccgccugagcgggaccgcccucauccgggcgggcuccgucggcgccgaggccugccugaugcugaagggggugaaggaggaccagaccaaguuccucaagaucaagaccgugagcuccgagcugagcugccgcgagggccaguccuacuggacggggagcuucucccccaagugccugagcucccggcgcugccaccuggucggcgagugccacgugaaccgcugccucagcuggcgggacaacgagaccuccgccgaguucagcuucgugggcgagagcaccaccaugcgcgagaacaagugcuucgagcagugcgggggcugggggugcggcugcuucaacgucaaccccuccugccuguucgugcacacguaccugcagagcgugcggaaggaggcccuccgcgucuucaacugcaucgacugggugcacaagcugacccuggagaucaccgacuucgacggguccgugagcaccaucgaccucggcgcguccagcucccgguucaccaacuggggcagcgucucccugagccuggacgccgaggggaucuccggcagcaacuccuucagcuucaucgaguccccggggaagggcuacgccaucguggacgagcccuucagcgagaucccccgccagggguuccucggcgagauccggugcaacuccgagagcuccgugcugagcgcccacgagagcugccugcgcgcgcccaaccucaucuccuacaagccgaugaucgaccagcuggagugcacgaccaaccugaucgaccccuucgucguguucgagcggggcagccucccccagacccgcaacgacaagaccuucgccgccuccaaggggaaccggggcgugcaggccuucagcaagggguccguccaggccgaccugacgcugauguucgacaacuucgagguggacuucgugggcgcggccgucagcugcgacgccgccuuccucaaccugaccgggugcuacuccugcaacgccggcgcgcgcgugugccugagcaucaccuccaccggcacggggagccucuccgcccacaacaaggacggcagccugcacaucgugcugcccuccgagaacgggaccaaggaccagugccagauccuccacuucaccgucccggagguggaggaggaguucauguacagcugcgacggcgacgagcggccccugcuggugaaggggacccucaucgccaucgaccccuucgacgaccgccgggaggccggcggcgaguccacggucgugaaccccaagagcggguccuggaacuucuucgacugguucagcggccugauguccugguucgggggcccgcugaagaccauccuccugaucugccuguacguggcccucagcaucggccuguucuuccugcucaucuaccuggggcgcaccggccugagcaagauguggcucgcggccaccaagaaggccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17404 - RNA, 2050 nt, Artificial Sequence
  mRNA product Design2 comprising derived and/or modified sequence from RVFV(ZH-548)__DQ380206.1__IgE-leader_Gn(delSP)-variant1 (opt1)
ggggcgcugccuacggagguggcagccaucuccuucucggcaucaagcuuaccauggacuggaccuggauccuguuccucguggccgccgcgacccgcguccacagcgaggacccccaccuccggaaccgcccgggcaaggggcacaacuacaucgacggcaugacgcaggaggacgcgaccugcaagcccgugaccuacgccggggccugcuccagcuucgacgugcugcuggagaagggcaaguucccccuguuccaguccuacgcccaccaccggacccugcucgaggccguccacgacacgaucaucgccaaggccgacccgcccagcugcgaccugcuguccgcccacgggaaccccugcaugaaggagaagcucgugaugaagacccacugccccaacgacuaccagagcgcgcacuaccugaacaacgacggcaagauggccuccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagacgaagaugaagggggucugcgaggugggcgugcaggcccugaagaagugcgacgggcagcuguccaccgcccacgaggucgugcccuucgcgguguucaagaacagcaagaaggucuaccucgacaagcuggaccugaagaccgaggagaaccuccugcccgacuccuucgugugcuucgagcacaagggccaguacaagggcaccauggacagcgggcagacgaagcgggagcugaaguccuucgacaucagccagugcccgaagaucggcgggcacggcuccaagaagugcaccggcgacgccgccuucugcagcgccuacgagugcaccgcccaguacgcgaacgccuacugcagccacgccaacggguccggcaucgugcagauccaggucagcgggguguggaagaagccccucugcgugggcuacgagcgcgucguggugaagcgggagcuguccgccaagcccauccagcgcgucgagcccugcaccacgugcaucaccaagugcgagccgcacgggcugguggugcggagcaccggcuucaagaucuccagcgccgucgcgugcgccuccggcgugugcgucaccgggagccagucccccagcacggagaucacccucaaguaccccggcaucucccagagcuccgggggcgacaucggggugcacauggcccacgacgaccagagcguguccagcaagaucgucgcccacugcccgccccaggaccccugccuggugcacgacugcaucgugugcgcccacggccugaucaacuaccagugccacaccgcgcucuccgccuucgucgugguguucgucuucagcuccaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaacccggcccccaucccccggcacgcgcccaucccgcgcuacagcacguaccucaugcugcugcucaucgugagcuacgccuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17405 - RNA, 2044 nt, Artificial Sequence
  mRNA product Design2 comprising derived and/or modified sequence from RVFV(ZH-548)__DQ380206.1__IgE-leader_Gn(delSP)-variant2 (opt1)
ggggcgcugccuacggagguggcagccaucuccuucucggcaucaagcuuaccauggacuggaccuggauccuguuccucguggccgccgcgacccgcguccacagcccccaccuccggaaccgcccgggcaaggggcacaacuacaucgacggcaugacgcaggaggacgcgaccugcaagcccgugaccuacgccggggccugcuccagcuucgacgugcugcuggagaagggcaaguucccccuguuccaguccuacgcccaccaccggacccugcucgaggccguccacgacacgaucaucgccaaggccgacccgcccagcugcgaccugcuguccgcccacgggaaccccugcaugaaggagaagcucgugaugaagacccacugccccaacgacuaccagagcgcgcacuaccugaacaacgacggcaagauggccuccgugaagugcccgcccaaguacgagcugaccgaggacugcaacuucugccgccagaugaccggcgccagccucaagaagggguccuacccccugcaggaccuguucugccagagcuccgaggacgacggcagcaagcucaagacgaagaugaagggggucugcgaggugggcgugcaggcccugaagaagugcgacgggcagcuguccaccgcccacgaggucgugcccuucgcgguguucaagaacagcaagaaggucuaccucgacaagcuggaccugaagaccgaggagaaccuccugcccgacuccuucgugugcuucgagcacaagggccaguacaagggcaccauggacagcgggcagacgaagcgggagcugaaguccuucgacaucagccagugcccgaagaucggcgggcacggcuccaagaagugcaccggcgacgccgccuucugcagcgccuacgagugcaccgcccaguacgcgaacgccuacugcagccacgccaacggguccggcaucgugcagauccaggucagcgggguguggaagaagccccucugcgugggcuacgagcgcgucguggugaagcgggagcuguccgccaagcccauccagcgcgucgagcccugcaccacgugcaucaccaagugcgagccgcacgggcugguggugcggagcaccggcuucaagaucuccagcgccgucgcgugcgccuccggcgugugcgucaccgggagccagucccccagcacggagaucacccucaaguaccccggcaucucccagagcuccgggggcgacaucggggugcacauggcccacgacgaccagagcguguccagcaagaucgucgcccacugcccgccccaggaccccugccuggugcacgacugcaucgugugcgcccacggccugaucaacuaccagugccacaccgcgcucuccgccuucgucgugguguucgucuucagcuccaucgccaucaucugccuggccauccuguaccgcgugcucaagugccugaagaucgcgccccggaaggugcugaacccccucauguggaucaccgccuucauccgcuggaucuacaagaagauggucgcccggguggccgacaacaucaaccaggugaaccgcgagaucggcuggauggagggcgggcagcugguccuggggaacccggcccccaucccccggcacgcgcccaucccgcgcuacagcacguaccucaugcugcugcucaucgugagcuacgccuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17406 - RNA, 1960 nt, Artificial Sequence
  mRNA product Design2 comprising derived and/or modified sequence from RVFV(ZH-548)__DQ380206.1__IgE-leader_Gc (opt1)
ggggcgcugccuacggagguggcagccaucuccuucucggcaucaagcuuaccauggacuggaccuggauccuguuccucguggccgccgcgacccgcguccacagcugcuccgagcugauccaggccagcucccggaucacgaccugcagcaccgagggcgugaacaccaagugccgccuguccgggacggcccucauccgggccggcagcgugggggccgaggcgugccugaugcugaagggcgucaaggaggaccagaccaaguuccucaagaucaagaccguguccagcgagcuguccugccgcgaggggcagagcuacuggaccggcuccuucagccccaagugccuguccagccggcgcugccaccucgugggcgagugccacgucaaccggugccuguccuggcgcgacaacgagacgagcgccgaguucuccuucgugggggagagcaccaccaugcgggagaacaagugcuucgagcagugcggcggguggggcugcgggugcuucaacgugaacccguccugccuguucguccacaccuaccuccagagcgugcgcaaggaggcccugcggguguucaacugcaucgacuggguccacaagcugacgcucgagaucaccgacuucgacggcagcguguccaccaucgaccugggcgccagcuccagccgcuucaccaacuggggguccgugagccugucccucgacgcggagggcaucagcggguccaacagcuucuccuucaucgagagccccggcaagggcuacgccaucgucgacgagcccuucuccgagaucccccggcagggguuccugggcgagauccgcugcaacagcgaguccagcgugcuguccgcccacgagagcugccuccgggccccgaaccugaucuccuacaagcccaugaucgaccagcuggagugcacgaccaaccucaucgaccccuucguggucuucgagcgcgggagccugccccagacccggaacgacaagaccuucgccgcgagcaagggcaaccgcggggugcaggccuucuccaagggcagcgugcaggccgaccugacgcucauguucgacaacuucgaggucgacuucgugggcgccgccguguccugcgacgcggccuuccugaaccugaccgggugcuacagcugcaacgccggcgcccgggucugccucuccaucaccagcaccgggacgggcucccugagcgcccacaacaaggacgggucccugcacaucgugcucccgagcgagaacggcaccaaggaccagugccagauccugcacuucaccguccccgagguggaggaggaguucauguacuccugcgacggcgacgagcgcccccugcucgugaaggggacccugaucgcgaucgaccccuucgacgaccggcgcgaggccggcggggagagcacggucgugaacccgaaguccggcagcuggaacuucuucgacugguucuccgggcugaugagcugguucggcggcccccucaagaccauccugcugaucugccucuacguggcccuguccaucgggcuguucuuccuccugaucuaccugggccgcaccgggcucagcaagauguggcuggccgccaccaagaaggcgagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17407 - RNA, 1120 nt, Artificial Sequence
  mRNA product Design2 comprising derived and/or modified sequence from RVFV(ZH-548)__DQ380151.1__N (opt5)
ggggcgcugccuacggagguggcagccaucuccuucucggcaucaagcuuaccauggacaacuaccaagagcuggccauccaauucgcugcccaggcgguggauagaaaugaaauugagcaguggguccgggaauuugcuuaucagggcuucgacgcccgcagaguuaucgagcuccugaagcaauacgggggagccgauugggaaaaagacgcuaagaaaaugauugugcuugcccugacccggggcaacaagccccgcagaaugaugaugaaaaugagcaaggaggggaaggcuacaguggaggcccucaucaauaaauauaagcugaaagaaggaaacccuucccgggaugagcuuacgcugucucgcgucgcggccgcucucgccggcuggaccugccaggcucuggugguucugagcgaauggcucccggugacagggaccacaauggacggacugucccccgccuacccuagacacaugaugcaucccucuuuugcgggcauggucgauccuagccuucccggcgacuaucugcgggccauucucgaugcucacucccuguaccuucugcaguucucucgcgugaucaauccuaaccucagagggcggaccaaggaggagguugccgcuacauuuacccagccgaugaaugccgccgugaacagcaauuucaucucccaugaaaaacgcagagaguuucugaaggcuuucggacuggucgacagcaacggcaagcccucugcggccgugauggcugccgcccaggcuuauaaaacggccgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17408 - RNA, 3976 nt, Artificial Sequence
  mRNA product Design2 comprising derived and/or modified sequence from RVFV(ZH-548)__DQ380206.1__GP (opt5)
ggggcgcugccuacggagguggcagccaucuccuucucggcaucaagcuuaccauguacgugcugcucaccauccugauuagcguccuuguuugcgaggccgugaucagagugucccugucuagcacacgggaagagacguguuucggcgacuccaccaaccccgaaaugauugagggggcuugggauucucuccgcgaagaggagaugccugaagaacugagcugcuccaucucuggaauuagagaagucaagacaagcucccaggagcuuuaucgggcccugaaagcgaucaucgcugccgacggccucaauaacauuaccugucacgggaaggauccggaggacaaaaucagccugauuaagggacccccucauaaaaagcgcgugggcaucguuagaugcgaacggcgcagagaugccaagcaaauugggcgggagacaauggcuggaaucgccaugaccgugcugcccgcucucgccgucuuugcgcuggccccugugguuuucgcugaagacccccaccuucgcaauagaccuggcaaaggccauaacuacauugaugggaugacacaggaggacgccaccuguaagccggugacguaugcuggagccugcagcuccuuugauguccugcucgaaaaaggcaaguucccccuguuucagagcuacgcgcaccaucggacccuucuggaggccgugcacgacacaaucaucgcuaaagccgauccucccucuugugaccuccuguccgcucacgggaauccuugcaugaaggagaagcuggugaugaaaacccauugucccaacgauuaucagagcgcccacuaccucaauaacgacggaaagauggccucugucaaaugcccgccuaaguaugaacugacagaggacuguaauuucugccgccaaaugaccggcgcuucccuuaaaaaggggagcuacccccugcaggaucucuuuugccaguccucugaagacgauggaagcaaacugaagacgaagaugaaaggcguuugugaggugggcgugcaggcgcuuaagaaaugcgacgggcaacuguccacagcccaugaagucgugccuuucgcuguuuuuaagaacagcaaaaagguguaccucgauaagcuggaccugaaaaccgaggagaaucuccugcccgauucuuucgucuguuuugaacacaagggacaguauaaaggcacaauggacuccgggcagaccaagagagagcuuaaaucuuucgauauuucucagugccccaagaucggaggccacgggagcaagaaauguaccggagacgccgccuuuugcuccgcuuacgaauguacagcccaauaugcgaacgcuuacugcucucaugccaauggcagcggcauugugcagauccagguuuccgggguguggaagaaaccucugugugucggauaugagcggguggucgugaagcgcgaacucagcgccaaaccgauucaaagaguugagcccugcacgaccuguaucacaaagugcgagccucacggccuggugguccggucuaccggguucaagaucuccagcgcuguggccugcgcuucuggaguuugugugacaggcucccagagccccuccaccgaaauuacgcuuaaauacccugggaucucucagagcuccggcggagauauuggcguccauauggcccacgacgaccagucugugagcuccaagaucguggcgcauugucccccgcaagauccuugccugguucacgacugcauugucugugcccacgggcucaucaacuaucagugccauacagcucugagcgccuucgugguggucuuuguguucucuuccaucgcuauuaucugucuggccauucucuacagaguucugaaaugccuuaagaucgcgccccgcaaagugcugaauccucucauguggauuaccgccuuuauccgguggauuuacaagaaaauggucgcuagaguggccgauaacaucaaccagguuaaucgcgagaucggauggauggaaggcgggcagcuggugcugggaaaccccgcuccuauuccccggcacgccccgaucccuagauauagcaccuaccuuaugcuccugcugauugucucuuaugccuccgcuuguagcgagcucauccaagcgucuagccgcauuacaaccugcuccacagagggcgugaauacgaagugucggcugagcgggaccgcccuuaucagagcuggcucuguuggagccgaagccugccugaugcucaagggcgugaaagaggaccagacaaaguuccugaaaaucaagaccgucuccagcgaacuguccugccgcgaggggcagucuuacuggacaggcagcuuuucccccaaaugucuuucuagccggagaugccaucucgugggagaaugucacgugaaccgcugccuguccuggcgggauaaugagaccucugcugaguucagcuuugucggggaauccacgaccaugagagagaacaaguguuucgaacagugcggaggcuggggguguggcugcuuuaauguuaaccccagcugucuguucgugcacacauaucuccaaucugugcggaaggaggcccugcgcgucuuuaauugcauugacugggugcauaaacuuacccuggaaaucacagauuucgacggauccguuagcaccauugaucucggcgcgucuuccagcagauuuacgaacugggggucugugucccugagccuggacgcugagggaaucuccggcagcaauucuuucagcuucauugaguccccugggaagggauacgccaucgucgaugaaccguuuucugagaucccccggcagggcuuccuuggggaaauuagauguaacagcgaguccucugugcucagcgcccacgaauccugccugcgcgcuccuaaucugaucucuuauaaacccaugauugaccagcucgagugcacaaccaaccugaucgauccuuuuguuguguucgagcggggcagccuuccccagacaagaaaugacaagaccuuugccgcguccaaaggaaaccgcggcguccaggcuuucagcaaggggucugugcaagccgaccugacccucauguuugauaacuucgaaguugacuuugugggagccgcugucuccugugaugccgcuuuccugaaucugacaggcugcuacagcuguaacgccggggcgagagugugccuuucuauuacguccaccggaacaggcagccucuccgcccauaauaaggacggcucucugcacaucgugcugccuagcgagaacgggaccaaagaucagugucaaauccuccauuuuacaguccccgaaguugaggaggaguucauguacuccugcgacggagaugagcggccgcugcuugugaagggcacccugauugcuaucgacccuuuugaugaccgcagagaagccgggggagagagcacgguggucaaucccaaaucuggcuccuggaacuucuucgauugguuuagcgggcucaugucuugguucggaggcccucugaagacaauucugcuuaucugucuguauguggcucucagcauuggccuguuuuuccuccugaucuaccuugggcggaccggacuguccaaaauguggcucgccgccaccaagaaggcuucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17409 - RNA, 3586 nt, Artificial Sequence
  mRNA product Design2 comprising derived and/or modified sequence from RVFV(ZH-548)__DQ380206.1__Gn-Gc (opt5)
ggggcgcugccuacggagguggcagccaucuccuucucggcaucaagcuuaccauggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccuguccgcccauggcaacccuuguaugaaagagaagcugguuaugaagacacacugcccgaaugauuaucagucugcucacuaccucaacaaugacgggaaaauggccagcgugaagugucccccuaaauaugaacugaccgaggauugcaacuuuuguagacagaugacaggagcgucccuuaagaaaggcucuuacccccugcaggaccucuucugccaaagcuccgaggaugacggcagcaagcugaagaccaaaaugaagggggucugugaagugggaguucaggcccuuaaaaagugcgauggccagcugucuacggcucaugagguggucccuuuugccguguucaaaaauuccaagaaaguguaucucgacaagcuggaccugaagaccgaagagaaccuccugcccgauagcuuugucuguuucgagcacaaagggcaguacaagggaacaauggacucuggccaaaccaaacgggaacuuaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucagauccaagugucuggcguguggaaaaagccucugugcgucggguaugaacgcgugguugugaaaagagagcucagcgccaagcccauucagcgggucgaaccuuguacgacaugcaucaccaaaugugagccccacggacuggugguucgcuccacaggcuuuaagauuagcucugccguggcuugcgccuccggggucugugugaccggaagccagucucccagcaccgagaucacacuuaaguacccuggcauuucccaaucuagcggcggggauaucggaguccauauggcgcacgacgaucaguccgugagcucuaaaauuguugcucauugcccgccccaggacccuugucuggugcacgauugcaucgucugcgcccauggccucaucaauuaucagugucacacggcccuguccgcuuucgugguuguguucgucuuuagcucuauugccaucauuugccuggcuauccucuacagagugcugaagugucuuaaaauugcgccccggaaggugcugaacccucucauguggaucaccgccuucauccgcuggauuuauaaaaagaugguugccagagucgcugacaauaucaaccaagugaaucgggaaauuggguggauggagggaggccagcuggugcuugggaaccccgccccgaucccucgccacgcucccauuccuagauacuccacauaccugaugcuccugcugaucgucagcuaugccuccgcgugcucugaacucauccaggccagcucccggauuaccacauguucuaccgagggcgugaacacgaagugccgccugagcggaacagcucuuaucagagccggcuccguuggggcugaagccugucugaugcucaaaggagugaaggaggaucagaccaaauuucugaagauuaaaaccgucagcucugagcuguccugccgggaaggccaaagcuacuggacagggucuuucucccccaagugucuuagcucuagacgcugccaucucgugggagagugucacguuaaucggugccugagcuggagagacaacgaaaccuccgccgaguuuagcuucgugggcgaaucuacaacgaugcgcgagaauaaaugcuuugagcagugugggggcuggggaugcggcuguuucaacgucaauccuuccugccuguuugugcauaccuaucuccagagcguucggaaggaagcucugagaguguucaacuguaucgacuggguccacaaacuuacacuggagauuaccgauuuugacggguccgugucuacaaucgaucucggagcgagcuccucucgcuucaccaauuggggcagcgugucccugucucuggacgccgaagggauuagcggauccaacagcuuuucuuucaucgagucccccggcaaaggguacgcuaucgucgaugagccguucagcgaaauuccucggcagggcuuucuuggagagaucagaugcaauucugaauccagcguucucucugcccacgaguccugucugcgcgcccccaaccugauuagcuauaagcccaugaucgaccaacucgaaugcacgaccaaucugauugauccuuucgugguguuugagcggggcucccuuccgcagacaagaaacgacaaaaccuucgcugccagcaaggggaaucgcggaguccaggcguuuucuaaaggcagcgugcaggcugaucugacacucauguucgacaacuuugagguugauuucgugggggccgccgucuccugugacgcugccuuucugaaucugaccggaugcuacucuuguaacgcgggcgcucgggugugccuuagcaucacguccacagggaccggcucucucagcgcccauaacaaggauggaucccugcacaucguucugcccucugaaaauggcacaaaggaccaaugccagauucuccauuucaccgugccugaggucgaagaggaauuuauguauagcugugacggggaugagagaccccugcuugugaaaggaacccugaucgccauugacccuuucgaugaccggcgcgaggcuggcggggaauccacaguugugaaccccaagagcggaucuuggaacuuuuucgauugguucuccggccucaugagcugguuuggcgggccucugaaaacgauccugcuuauuugccucuacgucgcccugucuaucggacuguucuuucuccugaucuaccuuggcagaaccgggcuguccaagauguggcucgcugccacaaagaaggcgagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17410 - RNA, 3337 nt, Artificial Sequence
  mRNA product Design2 comprising derived and/or modified sequence from RVFV(ZH-548)__DQ380206.1__Gne_SP-Gn_Gc (opt5)
ggggcgcugccuacggagguggcagccaucuccuucucggcaucaagcuuaccauggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccuguccgcccauggcaacccuuguaugaaagagaagcugguuaugaagacacacugcccgaaugauuaucagucugcucacuaccucaacaaugacgggaaaauggccagcgugaagugucccccuaaauaugaacugaccgaggauugcaacuuuuguagacagaugacaggagcgucccuuaagaaaggcucuuacccccugcaggaccucuucugccaaagcuccgaggaugacggcagcaagcugaagaccaaaaugaagggggucugugaagugggaguucaggcccuuaaaaagugcgauggccagcugucuacggcucaugagguggucccuuuugccguguucaaaaauuccaagaaaguguaucucgacaagcuggaccugaagaccgaagagaaccuccugcccgauagcuuugucuguuucgagcacaaagggcaguacaagggaacaauggacucuggccaaaccaaacgggaacuuaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucagauccaagugucuggcguguggaaaaagccucugugcgucggguaugaacgcgugguugugaaaagagagcucagcgccaagcccauucagcgggucgaaccuuguacgacaugcaucaccaaaugugagccccacggacuggugguucgcuccacaggcuuuaagauuagcucugccguggcuugcgccuccggggucugugugaccggaagccagucucccagcaccgagaucacacuuaaguacccuggcauuucccaaucuagcggcggggauaucggaguccauauggcgcacgacgaucaguccgugagcucuaaaauuguugcucauugcccgccccaggacccuugucuggugcacgauugcaucgucugcgcccauggccucaucaauuaucagugucacacggccauggcugggauugccaugaccgugcugcccgcucuggccguuuucgcgcucgccccuguggucuucgcugaagacugcuccgagcugauccaagccagcucuagaauuacaaccuguuccacagaaggagugaacaccaagugccggcuuagcggcacggcucugauccgcgccggguccgugggcgcggaggccugucucaugcugaaaggaguuaaggaagaucagacaaaauuucuuaagauuaagaccgucucuagcgagcuguccugcagagagggccagucuuacuggaccgggagcuucucccccaaaugucucagcucucggcgcugccaccuggugggagaaugucaugugaauagaugccuguccuggcgggacaacgagacaagcgcugaauuuucuuucgucggcgaguccaccacaaugcgcgaaaauaaguguuuugagcagugcgggggauggggcugcggguguuucaacgugaacccgagcugccucuuuguucacacguaucugcaaucugugagaaaagaggcccuucgggucuucaauuguaucgacugggugcauaagcugacccucgaaaucacagauuuugacggcagcguuuccaccauugaucugggagcuucuagcuccagauucacaaacuggggcagcgugucccugucucuugacgccgaggggaucagcggauccaauucuuuuagcuucauugaauccccuggcaaaggguacgccaucgucgaugagcccuuuucugagauuccucgccagggauuccucggcgaaauccggugcaacagcgaguccagcgugcugucugcucacgaauccugucugagagcgcccaaucucaucagcuacaagccuaugauugaccagcuggagugcaccacgaaccuuaucgaucccuucguuguguuugaacgcgggucucugccgcagacccggaaugacaaaacauucgccgcuuccaagggcaacagaggaguccaagccuuuagcaagggcucugugcaggccgaucucacccugauguucgacaauuuugagguggauuucgucggggcugccguuuccugugacgcggcuuuucugaaccuuacaggaugcuauagcuguaaugccggcgcccgcgugugccucuccauuaccagcacggggacaggaucucugagcgcucacaacaaagauggcucccugcauaucgugcucccuucugagaaugggaccaaggaccagugucagauucugcacuucacaguccccgaaguggaggaagaguuuauguacagcugcgacggcgaugaacggccccuucugguuaaaggaacccucaucgccauugacccuuucgaugacagacgcgaggcgggcggggaguccaccguggucaacccgaagucuggaagcuggaacuuuuucgauugguuuuccggccugaugucuugguucgggggaccccugaaaacaauccuucucaucugccuguauguggcucugagcauuggccucuucuuucugcuuaucuaccugggccggacggggcucuccaagauguggcuggccgccaccaagaaagcuagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17411 - RNA, 3571 nt, Artificial Sequence
  mRNA product Design2 comprising derived and/or modified sequence from RVFV(ZH-548)__DQ380206.1__IgE-leader_Gn(delSP)-Gc-variant1 (opt5)
ggggcgcugccuacggagguggcagccaucuccuucucggcaucaagcuuaccauggacuggaccuggauccuguuccucguggccgcugccacaagaguccacagcgaggauccccaucugcggaaccgcccuggcaaggggcacaauuacauugacggaaugacgcaggaagaugcgaccugcaaaccgguuacauaugcuggcgccuguuccucuuuugacgugcuucuggagaaggggaaauucccccucuuucaaagcuacgcccaucacagaacccugcuugaagcugugcaugauacaaucauugccaaggcugacccucccuccugcgaucugcucucugcccacggaaacccuuguaugaaagagaagcuggucaugaagacccacugccccaaugacuaucagagcgcgcauuaccugaacaaugauggcaaaauggccuccgugaaguguccuccgaaauaugaacucacagaggacugcaacuucugucggcagaugaccggggcuucucugaagaaaggaagcuacccccuucaggaucuguuuugccaauccagcgaggacgauggcucuaagcucaagacgaaaaugaagggcguuugugaaguggggguccaggcccugaaaaagugcgacggacagcuuuccaccgcucacgaggugguuccuuucgccguguuuaaaaauagcaagaaagucuaucuggacaagcucgaucugaagacagaagagaaccugcuccccgacucuuucguguguuuugagcauaaaggccaguacaaggggaccauggauuccggacaaacaaaacgcgaacuuaagagcuucgacaucucucagugcccuaaaauuggcgggcacggauccaagaagugcaccggcgaugcggccuuuuguagcgcuuacgagugcacggcccaguaugcuaaugccuacuguucccacgccaacggcucugggaucgugcagauccaagucagcggaguuuggaaaaagccccugugcgugggcuaugaaagaguggucgugaaacgggagcuguccgcuaagccgauucagcgcguugaaccuuguacaaccugcaucacaaaaugugagccccaugggcucguggucagaagcaccggauucaagauuucuuccgcgguggccugcgcuagcggcguuugugugaccgggucucagagcccuuccacagagaucacgcugaaguaccccggaauuucucaaagcuccggcggcgacaucgggguccacauggcccaugaugaccagagcgugucuuccaaaauugucgcccacugucccccucaggauccgugccuugugcaugacugcaucguuugcgcucacggacugaucaauuaucagugucacaccgcccucagcgcguuuguggucguguucguuuucucuuccauugcuaucauuugccuggccauccuguaccgggugcucaagugucugaaaauugcuccccgcaagguccuuaacccucugauguggaucacagccuuuaucagauggauuuauaaaaagaugguggcccggguggcugauaauaucaaccaaguuaaucgcgaaauuggcuggauggaagggggacagcucguccugggcaaccccgccccuauccccagacaugcgccgauuccucgguacagcaccuaccuuaugcugcuccugaucguguccuaugccucugcuugcagcgaacugauccaggccuccucucgcauuacaaccuguagcacggagggggugaacacaaagugcagacucuccggcaccgcucugauccgggccggaagcgucggcgcggaagccugucuuaugcugaaaggggugaaggaggaccagaccaaauuccucaagauuaaaacaguuucuuccgagcugagcugcagagaaggacaaucuuacuggaccggcuccuuuagccccaagugucugucuagccgccggugccaccuugugggggagugucaugucaauagaugccucuccuggcgcgacaacgaaacaagcgcugaguucucuuuugugggagaauccacgaccaugcgggagaauaaaugcuucgagcaguguggcggguggggcugcggauguuuuaacguuaauccuagcugccuguucgugcacacauaucugcaguccgucagaaaggaagcccuccgcguguuuaacuguaucgauuggguucacaagcugacccuugagauuacagacuucgauggcucugugagcaccaucgaccugggggcuuccucuagccgguuuacgaauuggggauccgucucucucagccuggaugccgaaggcauuuccgggagcaacucuuucuccuuuaucgagagccccggaaaaggcuacgccaucguggacgagccuuucucugaaauucccagacagggguuccugggcgagauccgcugcaauuccgaaagcucugugcuuuccgcucaugagagcugucuccgggcgccgaaccugauuuccuauaagccuaugaucgaucaacuggaaugcaccacaaaucucauugaccccuuugucguuuucgagagaggaagccugccccagacccgcaacgauaaaacauuugccgcuucuaagggcaauagaggggugcaggccuucagcaaaggauccgugcaggccgaccuuacccugauguuugauaacuucgaggucgacuuugugggcgcugccguuucuugugaugcggcuuuccucaaucugacggggugcuacagcuguaacgccggagcccgggugugccuguccaucacaucuaccggcacagggagccuuuccgcucacaacaaggacggcucucuccauaucguccugccuagcgaaaauggaaccaaggaccaaugccagauucugcacuuuaccgugccggagguugaagaggaguucauguauuccugugauggcgacgagcggccccuccuggugaaagggacacuuaucgccauugauccuuuugacgaucgcagagaggcgggaggcgaaagcacggucgugaaccccaagucuggguccuggaauuucuuugacugguucagcggacugaugucuugguucggcggcccucucaaaaccauccugcugauuugccuuuacguugcucucuccaucgggcuguuuuuccugcucaucuaccugggacggacaggccuuagcaagauguggcuggccgccaccaaaaaggcuuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17412 - RNA, 3565 nt, Artificial Sequence
  mRNA product Design2 comprising derived and/or modified sequence from RVFV(ZH-548)__DQ380206.1__IgE-leader_Gn(delSP)-Gc-variant2 (opt5)
ggggcgcugccuacggagguggcagccaucuccuucucggcaucaagcuuaccauggacuggaccuggauccuguuccucguggccgcugccacaagaguccacagcccccaucugcggaaccgcccuggcaaggggcacaauuacauugauggaaugacgcaggaggacgcgaccugcaaaccgguuacauaugcuggcgccuguuccucuuuugaugugcuucuggaaaaggggaaauucccccucuuucaaagcuacgcccaucacagaacccugcuugaggcugugcaugacacaaucauugccaaggcugauccucccuccugcgaccugcucucugcccacggaaacccuuguaugaaagaaaagcuggucaugaagacccacugccccaaugauuaucagagcgcgcauuaccugaacaaugacggcaaaauggccuccgugaaguguccuccgaaauaugagcucacagaagauugcaacuucugucggcagaugaccggggcuucucugaagaaaggaagcuacccccuucaggaccuguuuugccaauccagcgaggaugacggcucuaagcucaagacgaaaaugaagggcguuugugagguggggguccaggcccugaaaaagugcgauggacagcuuuccaccgcucacgaagugguuccuuucgccguguuuaaaaauagcaagaaagucuaucuggacaagcucgaccugaagacagaggaaaaccugcuccccgauucuuucguguguuuugagcauaaaggccaguacaaggggaccauggacuccggacaaacaaaacgcgagcuuaagagcuucgauaucucucagugcccuaaaauuggcgggcacggauccaagaagugcaccggcgacgcggccuuuuguagcgcuuacgaaugcacggcccaguaugcuaaugccuacuguucccacgccaacggcucugggaucgugcagauccaagucagcggaguuuggaaaaagccccugugcgugggcuaugagagaguggucgugaaacgggaacuguccgcuaagccgauucagcgcguugagccuuguacaaccugcaucacaaaaugugaaccccaugggcucguggucagaagcaccggauucaagauuucuuccgcgguggccugcgcuagcggcguuugugugaccgggucucagagcccuuccacagagaucacgcugaaguaccccggaauuucucaaagcuccggcggcgauaucgggguccacauggcccaugacgaucagagcgugucuuccaaaauugucgcccacugucccccucaggacccgugccuugugcaugauugcaucguuugcgcucacggacugaucaauuaucagugucacaccgcccucagcgcguuuguggucguguucguuuucucuuccauugcuaucauuugccuggccauccuguaccgggugcucaagugucugaaaauugcuccccgcaagguccuuaacccucugauguggaucacagccuuuaucagauggauuuauaaaaagaugguggcccggguggcugacaauaucaaccaaguuaaucgcgagauuggcuggauggaagggggacagcucguccugggcaaccccgccccuauccccagacaugcgccgauuccucgguacagcaccuaccuuaugcugcuccugaucguguccuaugccucugcuugcagcgagcugauccaggccuccucucgcauuacaaccuguagcacggaaggggugaacacaaagugcagacucuccggcaccgcucugauccgggccggaagcgucggcgcggaggccugucuuaugcugaaaggggugaaggaagaucagaccaaauuccucaagauuaaaacaguuucuuccgagcugagcugcagagagggacaaucuuacuggaccggcuccuuuagccccaagugucugucuagccgccggugccaccuugugggggaaugucaugucaauagaugccucuccuggcgcgacaacgagacaagcgcugaguucucuuuugugggagaauccacgaccaugcgggaaaauaaaugcuucgagcaguguggcggguggggcugcggauguuuuaacguuaauccuagcugccuguucgugcacacauaucugcaguccgucagaaaggaggcccuccgcguguuuaacuguaucgacuggguucacaagcugacccuugaaauuacagauuucgacggcucugugagcaccaucgaucugggggcuuccucuagccgguuuacgaauuggggauccgucucucucagccuggacgccgagggcauuuccgggagcaacucuuucuccuuuaucgaaagccccggaaaaggcuacgccaucguggaugagccuuucucugagauucccagacagggguuccugggcgaaauccgcugcaauuccgagagcucugugcuuuccgcucaugaaagcugucuccgggcgccgaaccugauuuccuauaagccuaugaucgaccaacuggagugcaccacaaaucucauugaucccuuugucguuuucgaaagaggaagccugccccagacccgcaacgacaaaacauuugccgcuucuaagggcaauagaggggugcaggccuucagcaaaggauccgugcaggccgaucuuacccugauguuugacaacuucgaggucgauuuugugggcgcugccguuucuugugacgcggcuuuccucaaucugacggggugcuacagcuguaacgccggagcccgggugugccuguccaucacaucuaccggcacagggagccuuuccgcucacaacaaggauggcucucuccauaucguccugccuagcgagaauggaaccaaggaccaaugccagauucugcacuuuaccgugccggaaguugaggaagaguucauguauuccugugacggcgaugaacggccccuccuggugaaagggacacuuaucgccauugacccuuuugaugaccgcagagaggcgggaggcgagagcacggucgugaaccccaagucuggguccuggaauuucuuugauugguucagcggacugaugucuugguucggcggcccucucaaaaccauccugcugauuugccuuuacguugcucucuccaucgggcuguuuuuccugcucaucuaccugggacggacaggccuuagcaagauguggcuggccgccaccaaaaaggcuuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17413 - RNA, 2050 nt, Artificial Sequence
  mRNA product Design2 comprising derived and/or modified sequence from RVFV(ZH-548)__DQ380206.1__IgE-leader_Gn(delSP)-variant1 (opt5)
ggggcgcugccuacggagguggcagccaucuccuucucggcaucaagcuuaccauggacuggaccuggauccuguuccucguggccgcugccacaagaguccacagcgaggauccccaucugcggaaccgcccuggcaaggggcacaauuacauugacggaaugacgcaggaggaugcgaccugcaaaccgguuacauaugcuggcgccuguuccucuuuugacgugcuucuggagaaggggaaauucccccucuuucaaagcuacgcccaucacagaacccugcuugaagcugugcaugauacaaucauugccaaggcugacccucccuccugcgaucugcucucugcccacggaaacccuuguaugaaagagaagcuggucaugaagacccacugccccaaugacuaucagagcgcgcauuaccugaacaaugauggcaaaauggccuccgugaaguguccuccgaaauaugaacucacagaggacugcaacuucugucggcagaugaccggggcuucucugaagaaaggaagcuacccccuucaggaucuguuuugccaauccagcgaggacgauggcucuaagcucaagacgaaaaugaagggcguuugugaaguggggguccaggcccugaaaaagugcgacggacagcuuuccaccgcucacgaggugguuccuuucgccguguuuaaaaauagcaagaaagucuaucuggacaagcucgaucugaagacagaagagaaccugcuccccgacucuuucguguguuuugagcauaaaggccaguacaaggggaccauggauuccggacaaacaaaacgcgaacuuaagagcuucgacaucucucagugcccuaaaauuggcgggcacggauccaagaagugcaccggcgaugcggccuuuuguagcgcuuacgagugcacggcccaguaugcuaaugccuacuguucccacgccaacggcucugggaucgugcagauccaagucagcggaguuuggaaaaagccccugugcgugggcuaugaaagaguggucgugaaacgggagcuguccgcuaagccgauucagcgcguugaaccuuguacaaccugcaucacaaaaugugagccccaugggcucguggucagaagcaccggauucaagauuucuuccgcgguggccugcgcuagcggcguuugugugaccgggucucagagcccuuccacagagaucacgcugaaguaccccggaauuucucaaagcuccggcggcgacaucgggguccacauggcccaugaugaccagagcgugucuuccaaaauugucgcccacugucccccucaggauccgugccuugugcaugacugcaucguuugcgcucacggacugaucaauuaucagugucacaccgcccucagcgcguuuguggucguguucguuuucucuuccauugcuaucauuugccuggccauccuguaccgggugcucaagugucugaaaauugcuccccgcaagguccuuaacccucugauguggaucacagccuuuaucagauggauuuauaaaaagaugguggcccggguggcugauaauaucaaccaaguuaaucgcgaaauuggcuggauggaagggggacagcucguccugggcaaccccgccccuauccccagacaugcgccgauuccucgguacagcaccuaccuuaugcugcuccugaucguguccuaugccucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17414 - RNA, 2044 nt, Artificial Sequence
  mRNA product Design2 comprising derived and/or modified sequence from RVFV(ZH-548)__DQ380206.1__IgE-leader_Gn(delSP)-variant2 (opt5)
ggggcgcugccuacggagguggcagccaucuccuucucggcaucaagcuuaccauggacuggaccuggauccuguuccucguggccgcugccacaagaguccacagcccccaucugcggaaccgcccuggcaaggggcacaauuacauugauggaaugacgcaggaggacgcgaccugcaaaccgguuacauaugcuggcgccuguuccucuuuugaugugcuucuggaaaaggggaaauucccccucuuucaaagcuacgcccaucacagaacccugcuugaggcugugcaugacacaaucauugccaaggcugauccucccuccugcgaccugcucucugcccacggaaacccuuguaugaaagaaaagcuggucaugaagacccacugccccaaugauuaucagagcgcgcauuaccugaacaaugacggcaaaauggccuccgugaaguguccuccgaaauaugagcucacagaagauugcaacuucugucggcagaugaccggggcuucucugaagaaaggaagcuacccccuucaggaccuguuuugccaauccagcgaggaugacggcucuaagcucaagacgaaaaugaagggcguuugugagguggggguccaggcccugaaaaagugcgauggacagcuuuccaccgcucacgaagugguuccuuucgccguguuuaaaaauagcaagaaagucuaucuggacaagcucgaccugaagacagaggaaaaccugcuccccgauucuuucguguguuuugagcauaaaggccaguacaaggggaccauggacuccggacaaacaaaacgcgagcuuaagagcuucgauaucucucagugcccuaaaauuggcgggcacggauccaagaagugcaccggcgacgcggccuuuuguagcgcuuacgaaugcacggcccaguaugcuaaugccuacuguucccacgccaacggcucugggaucgugcagauccaagucagcggaguuuggaaaaagccccugugcgugggcuaugagagaguggucgugaaacgggaacuguccgcuaagccgauucagcgcguugagccuuguacaaccugcaucacaaaaugugaaccccaugggcucguggucagaagcaccggauucaagauuucuuccgcgguggccugcgcuagcggcguuugugugaccgggucucagagcccuuccacagagaucacgcugaaguaccccggaauuucucaaagcuccggcggcgauaucgggguccacauggcccaugacgaucagagcgugucuuccaaaauugucgcccacugucccccucaggacccgugccuugugcaugauugcaucguuugcgcucacggacugaucaauuaucagugucacaccgcccucagcgcguuuguggucguguucguuuucucuuccauugcuaucauuugccuggccauccuguaccgggugcucaagugucugaaaauugcuccccgcaagguccuuaacccucugauguggaucacagccuuuaucagauggauuuauaaaaagaugguggcccggguggcugacaauaucaaccaaguuaaucgcgagauuggcuggauggaagggggacagcucguccugggcaaccccgccccuauccccagacaugcgccgauuccucgguacagcaccuaccuuaugcugcuccugaucguguccuaugccucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17415 - RNA, 1960 nt, Artificial Sequence
  mRNA product Design2 comprising derived and/or modified sequence from RVFV(ZH-548)__DQ380206.1__IgE-leader_Gc (opt5)
ggggcgcugccuacggagguggcagccaucuccuucucggcaucaagcuuaccauggacuggacauggauccuguuccucguggccgcugccacaagaguccacagcugcuccgagcugauucaggcgucuagccggaucacgaccuguuccacagaaggcguuaauaccaagugccgccuuucugggacagcucugauuagagccggaagcgugggcgccgaggcuugucucaugcugaaaggggugaaggaagaucaaaccaaauuucuuaagaucaaaacagucuccucugagcugagcugccgggaaggacaguccuacuggaccggcagcuucucucccaagugucucuccagccgcagaugccaucuggugggggagugucacguuaaucggugccugucuuggcgcgacaacgagacguccgccgaauuuagcuucgugggagagucuaccacaaugagagaaaauaaguguuuugagcagugcggcggcuggggguguggaugcuucaacgucaauccuuccugccucuuugugcauaccuaucugcagagcguucggaaagaggcucuccgcguguucaacuguauugauuggguccacaagcugacacucgaaaucaccgacuuugauggcuccgugucuacgaucgaccugggggccagcuccagcagauucacaaauuggggaucugugucccuuagccuggaugcggagggcauuucugggagcaacuccuuuucuuucaucgaaagcccgggaaaaggcuacgccauugucgacgagcccuuuuccgaaaucccucggcaaggcuuccucggggagauucgcugcaauagcgagucuuccguucugagcgcucaugaaucuugucugagagcccccaaccucaucuccuauaagccuaugauugaucagcuggagugcaccacaaaucuuaucgaccccuucgugguguuugaacggggaagccugccucagacccgcaacgauaaaaccuucgcugccuccaagggcaauagagggguccaggcguuuucuaagggaagcgugcaagccgaccucacacugauguucgauaacuuugagguugacuucgugggcgcugccgucuccugugacgcugccuuucuuaaucugacggggugcuacucuuguaacgccggagcucgggugugccucagcaucaccuccacaggcaccggcagccugucugcgcacaacaaagaugggucccugcacauuguucucccgagcgaaaauggaacaaaggaccagugucagauccugcauuucaccgugcccgaggucgaggaagaguuuauguauucuugcgauggcgacgaaagaccucuucuggugaaagggacgcucauugccaucgaucccuucgacgaucgccgggaggcuggaggcgaauccacagucgugaacccuaagagcgggucuuggaacuuuuucgacugguuuagcggccugauguccugguucggaggcccccuuaaaaccauucugcucaucugucuguacguugcccugagcaucgggcuuuucuuucugcuuauuuaucugggaagaaccggccucucuaagauguggcuggccgcuaccaaaaaggccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17416 - RNA, 1120 nt, Artificial Sequence
  mRNA product Design2 comprising derived and/or modified sequence from RVFV(ZH-548)__DQ380151.1__N (opt11)
ggggcgcugccuacggagguggcagccaucuccuucucggcaucaagcuuaccauggacaacuaccaagaacucgcaauccaguucgccgcccaagccgucgaccgcaacgaaaucgaacaauggguccgagaauuugccuaccaaggcuucgacgcccgacgagucaucgaacuccucaaacaauacggaggcgccgacugggaaaaagacgccaagaaaaugaucguacuagcccucacccgaggcaacaaaccccgccgaaugaugaugaaaaugucaaaagaaggcaaagccaccgucgaagcccucaucaacaaauacaaacucaaggaaggcaaccccucccgggacgaacucacacucucccgcguagccgcagcccucgccggcuggaccugccaagcccucgucguccuauccgaauggcuuccagucacaggcacaaccauggacggccucucccccgccuauccccgccacaugaugcaccccucauucgccggcauggucgaccccucacuccccggcgacuaccuacgagccauccuagacgcacacucccucuaccuccuccaauucucccgcgucaucaaccccaaccuacgcggccgcaccaaagaagaaguagccgccaccuucacacaaccaaugaacgccgcagucaacuccaacuucaucucccacgaaaaacgccgcgaauuucucaaagccuucggccuuguagacuccaacggcaaacccuccgccgccgucauggcugccgcacaagcguacaaaaccgccgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17417 - RNA, 3976 nt, Artificial Sequence
  mRNA product Design2 comprising derived and/or modified sequence from RVFV(ZH-548)__DQ380206.1__GP (opt11)
ggggcgcugccuacggagguggcagccaucuccuucucggcaucaagcuuaccauguacguucugcucaccauacucaucuccguccucgucugugaagcaguuauucgggucucacuaucgagcacucgggaagagacaugcuucggagacuccaccaauccagaaaugauagagggugccugggacucauuacgagaggaagaaaugccagaggaacucucgugcucaauaucgggcauucgggaggucaaaacguccagucaagagcuauaucgcgcacugaaagcaaucauugcagccgacggacucaauaacaucacgugccauggaaaagacccagaggacaaaauaucacuaaucaagggcccaccacacaagaaacgagucggcauaguccgaugcgaacgucgccgcgacgccaaacaaaucggucgagaaaccauggccggaaucgcaaugaccguacuacccgcccucgcgguuuucgcccuagcacccgucgucuucgcggaagacccccaccuccgcaaccggccaggcaaaggucacaacuauauagacggaaugacgcaggaagacgcaacauguaaaccaguaaccuaugccggcgcaugcagcucauuugacguccuccucgagaaaggcaaguucccgcuauuccaaagcuacgcucaccaccgcacccuccuggaggccguacacgacacaauaaucgcgaaagcggacccacccaguugcgaucuacuaucggcccacggaaaucccuguaugaaagaaaagcuaguuaugaaaacccauugccccaacgacuaccagagcgcccacuaccucaacaaugaugggaaaauggccucagucaaaugcccgcccaaauacgaacuaaccgaggacugcaacuucugccgccaaaugaccggagccucacuaaagaaaggcucuuacccccuccaagaccucuuuugccaaucguccgaggacgauggcucaaaacuuaaaacaaaaaugaaaggugucugcgaagucggagugcaagcccugaagaaaugugacggacaacucuccacagcccacgaaguaguacccuucgccguauucaaaaacucaaagaaaguauaccuggacaaacuggaccuuaaaacagaggaaaaccugcugcccgacuccuuugugugcuucgaacacaaaggccaauacaaaggcacuauggacagcggacagaccaaacgggaacuaaagagcuucgacaucucccaaugucccaaaauuggcggccacggauccaagaaauguacaggggacgccgccuucugcucagccuacgaaugcaccgcgcaauacgcuaacgcguacugcucccaugccaacggguccggcaucguccagauccaagucuccggcguguggaagaaaccucucuguguaggcuaugaacgcgucguagucaaaagagaacucucugcuaaacccauccaacggguggaaccaugcaccacgugcauaacaaaaugcgagccacacggccucguuguucgauccacaggcuuuaaaaucucaagcgcuguagccugcgcauccggcgucugcgucaccgguucucaguccccaucaacagagaucacacugaaauaccccggcauaucccaaucaucgggcggcgacauaggaguucacauggcucacgacgaccagagcguauccuccaaaaucgucgcccacugcccaccccaggaccccugccucguucaugacugcaucgucugugcacacggccucauaaacuaccaaugccacaccgcccuauccgccuuugucgugguauucguauucagcagcaucgcaaucauaugccuugcaauccuguaccgcguccugaaaugccuuaaaauugccccacgcaaaguccucaacccacugauguggaucacugccuucauacgcuggauauacaagaaaauggucgcccgcguagccgacaacaucaaccaaguaaaccgagagauaggcuggauggagggcggccaacucguccuuggcaacccagccccaauacccaggcacgcaccgauuccucgguauuccacauaccucaugcuccuucugaucgucagcuacgcaucggccugcuccgaacucauacaggcauccagcagaauuacaaccuguucaaccgagggcgucaacacgaaaugucgucuguccgguaccgcacuaauacgcgcugguucaguaggagcggaggccugucuuaugcuuaaaggcguaaaagaggaucaaaccaaauuccugaaaaucaaaacagugagcucggaacucucaugccgcgaaggacaauccuacuggacaggaucguucucaccaaaaugccuaucuagcagacgaugccaccucgucggggagugccaugugaaucgcugccucuccuggcgagacaacgagacaagcgccgaguucucuuucguaggggaaagcaccaccaugagagaaaacaaaugcuucgaacagugcggcggauggggaugcggcugcuuuaacgucaaccccucgugccuguuuguacauacuuaccuccaaucaguacgcaaagaagcauugcgcguuuucaauugcaucgacuggguccacaaacucacccuagaaaucacagacuucgacggcuccgucucgaccaucgaccugggcgccagcuccucaagguucacgaacuggggcuccguaucccucucccuugacgcggaaggaaucuccggcagcaacucguucucauucaucgaaucacccggaaaaggcuacgccaucgucgacgaacccuucuccgaaauaccgagacaaggauuccucggagaaaucagaugcaacucagagagcuccgugcugucugcccacgaaaguugccucagagcacccaaccucaucagcuacaaaccaaugaucgaucaacuagaaugcacuacuaaccuaauagaccccuuugucguuuucgaacgcggcucccucccacaaaccaggaacgacaaaaccuuugcagcuaguaaaggaaacagaggaguccaagcguucucaaaaggcucaguccaagcagaucuaacccucauguucgacaacuucgagguugacuucgugggcgccgcagucuccugugacgcagcguucuugaaccucacaggcugcuacucuugcaacgccggagcaagaguuugccucucaaucacgagcacaggaacgggaucccuaucagcccacaacaaagacggcagccuucacaucguacucccgucugagaacggaaccaaagaucaaugucaaauccuacacuucaccguacccgaagucgaagaagaguucauguacucuugcgacggcgacgaacgaccacuacucgucaaagggacccucaucgcaauugacccauucgaugaucgccgcgaagcuggaggcgagagcacagucgucaaccccaaaagcggcuccuggaacuuuuucgacugguucagcggacucauguccugguuugguggcccacucaaaacaauccuccucaucugccucuacguagcccugagcaucggccucuucuuccuccuuaucuaccuagggcgaacagggcuuucgaaaauguggcuugcugccaccaagaaagccuccuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17418 - RNA, 3586 nt, Artificial Sequence
  mRNA product Design2 comprising derived and/or modified sequence from RVFV(ZH-548)__DQ380206.1__Gn-Gc (opt11)
ggggcgcugccuacggagguggcagccaucuccuucucggcaucaagcuuaccauggcaggaauagcaaugacgguucugccagcgcuagccguuuucgcacuagcaccagucgucuucgcggaagacccccaucuacgcaaccgacccggaaaaggacacaacuacaucgacggaaugacacaagaagaugcaacaugcaaaccagucacauacgcaggcgccugcuccuccuucgacguccuacuugagaaagguaaauucccccucuuucaaagcuacgcgcaccaccguacccuccucgaagcaguccacgacacaaucauagcaaaggcugacccacccagcugugaccuccucuccgcccauggcaaccccugcaugaaggaaaaacucguaaugaaaacacacugcccgaacgacuaccaauccgcccacuaccucaacaacgacggaaagauggccucuguuaagugcccaccaaaauacgagcugaccgaagacugcaacuuuugccgucaaaugaccggagccucccucaagaaagggucauacccacuccaagaucuauuuugccaaagcuccgaggacgacggcagcaaauuaaaaaccaagaugaaagguguaugcgaagugggcguccaggcccucaagaaaugcgacggccaacuuuccacugcacacgaagugguacccuucgccguguucaaaaacuccaagaaagucuauuuagacaaacucgaccuaaaaacggaagagaaccuccuacccgacucauuugucugcuuugagcacaaaggccaauacaaaggaacaauggauagcgggcaaacaaaaagggaacucaaguccuucgacaucagccagugccccaaaaucggcggacaugggagcaaaaagugcaccggcgacgcugcauucugcagugccuacgagugcaccgcgcaauacgcuaacgcauacugcagucaugcuaacggcagcggaauuguacaaauccaggucuccggcguguggaagaaaccacuaugcguaggcuacgaacggguugucgucaaaagagagcuuuccgccaaacccauucaacgaguugaaccaugcacuacauguaucaccaaaugugaaccucauggucuaguuguccgcucgaccggauucaagaucucgagcgccguagccugcgccuccggagugugcgucacaggcucacaaucccccucgacagaaauuacccugaaauacccuggaaucucccaguccucgggaggcgacauagggguacacauggcccacgacgaccaaagcgucuccuccaaaauaguagcucacugcccaccacaggaccccugucucguacacgacugcauaguaugugcacauggucucaucaacuaccaaugccacacagcacucagugcauuuguaguuguauucguauucuccucuaucgccaucaucugccuagccauacucuacaggguccucaaaugccuaaaaaucgcaccacgaaaaguccucaacccccuaauguggauaaccgccuucauccgcuggauauacaagaaaauggucgcccgcgucgcagacaacaucaaucaagucaaccgugaaaucggcuggauggaaggaggacaacugguccuuggaaacccagcgccaauaccccgccacgccccaauuccucgauacuccaccuaccuaaugcuucuccuaaucguauccuacgccuccgccugcagcgaacucauacaggcuuccucacgcauaacuacgugcuccaccgaaggaguuaacaccaaaugccgacucucagggacagcccuaaucagagcgggaaguguaggcgcagaagccugccuuaugcugaaaggagucaaagaggaccaaacaaaauuccuaaagaucaaaaccgucucaucugagcucagcugccgcgaaggacaauccuacuggacagguuccuucucccccaaaugccugucaucccgcagaugccauuuagucggcgagugccauguaaaccgaugccucuccuggcgcgacaacgagacuucagcggaguucagcuucguaggggaaucuacaaccaugcgugagaacaagugcuucgaacaaugcggaggcuggggaugcgguugcuucaacgucaacccauccugccuauucguacauacuuaccuccaguccgucagaaaagaggcgcuacgcgucuucaacuguauagacuggguucacaaacuuacccuggaaauaaccgacuucgacggauccgucagcacaauagaucugggagcuuccagcucacguuucacgaacuggggguccgucucgcuuucucuagacgccgaaggcauaagcggcuccaacuccuucuccuucaucgaaagccccggcaaaggcuacgccaucguagacgagccauucucagagaucccccgccaaggcuuccucggcgagaucagauguaacagcgaauccuccguacucucagcacacgaauccugccuucgcgcaccaaaucuuaucuccuacaaacccaugaucgaccaacuagaauguaccaccaaucuaauagaucccuucguaguauucgaacgcggcucucuaccccaaacacgcaacgacaaaacauucgcggccuccaaagggaaccggggcgugcaagccuucuccaaaggaaguguccaagccgaucucacacucauguucgacaacuuugaaguagacuucgucggggcggccguaaguugcgaugcggccuuccuaaaccugaccggcuguuacucaugcaacgcgggcgccagagucugccucuccauaaccuccaccggaaccggaucacugucagcacacaacaaagacggaucccuacacaucguccuuccauccgaaaauggcacaaaagaccaaugccaaaucuuacacuucaccgucccagaaguagaagaagaguucauguacaguugcgacggagaugagcgcccguuacucguaaagggcacacuuauagccauugacccguucgacgacagacgugaggccggaggagaaagcaccgucguaaauccaaagucagggucauggaacuucuucgacugguuuuccggauuaauguccugguucggaggcccucucaaaacuauacuccuaauaugccuauacgucgcccucuccaucggccuauucuuccuccuaauauaccucggacgcacaggccucuccaaaauguggcuagccgccaccaaaaaggccuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17419 - RNA, 3337 nt, Artificial Sequence
  mRNA product Design2 comprising derived and/or modified sequence from RVFV(ZH-548)__DQ380206.1__Gne_SP-Gn_Gc (opt11)
ggggcgcugccuacggagguggcagccaucuccuucucggcaucaagcuuaccauggcaggaaucgccaugacaguccuaccagcacuugccguauuugcccucgccccaguaguauuugccgaagacccacaccucagaaaccgacccggaaaaggacacaacuauaucgauggcaugacccaggaagaugcaacaugcaaaccuguaaccuacgccggcgcaugcuccagcuucgacguacuacuugagaaaggcaaauuuccacucuuucaaucuuacgcucaccaccgcacccuucuagaggccguccacgacacgaucauagcuaaagccgacccaccaagcugcgaccuccucucagcccauggcaacccaugcaugaaagagaaacucguaaugaaaacccacugccccaacgacuaccaguccgcucacuaccucaauaacgacggaaaaauggccucagucaaaugcccacccaaauacgagcuuacagaggacugcaacuucugccgccaaaugaccggagccucacucaagaaaggaagcuacccccuucaggaccuauucugccagagcucagaagacgacgguagcaagcuaaaaaccaaaaugaaagggguuugcgaggucggcguccaggcgcucaagaaaugcgacggucaacucucuacagcacaugaagucguacccuucgccguuuucaaaaacagcaagaaagucuaccucgacaaacuagaccucaaaaccgaagaaaaccuacuccccgacagcuucgugugcuucgaacacaaaggccaauauaaaggcacgauggacuccggacagaccaaaagggaacuaaaauccuucgacauaucccaaugccccaaaaucggaggccacggauccaagaaaugcaccggagacgccgccuucugcucagcauacgaaugcacagcacaauacgccaacgcauacugcagccacgcaaacggauccggaauagugcagauccaaguaagcggagucuggaagaaaccccucugugucggcuacgaacgcguggucguaaaaagagagcuuucagcuaaaccaauacaacgaguagaacccugcaccacgugcauuacaaaaugcgaaccacacggccucgucguucgcagcacugguuucaaaauaucuagcgcgguagcaugcgccucaggcguaugcgugaccggaucccagucaccaucaacagaaaucacccucaaauacccgggcauuucacaaucaucagguggcgacaucgggguacacauggcacacgacgaucaauccgucucuucaaaaaucgucgcccacugcccaccccaggaccccuguuuagugcacgacuguauagucugcgcccacggccuaauuaacuaccaaugccacaccgccauggccggaaucgcaaugacagucuuaccggcccucgcaguauucgcccuagccccaguugucuucgcagaagacugcucagaacuaauccaagccucuucccgaaucaccacaugcagcaccgaaggcgucaacacaaaaugccgccucucgggcaccgcccucauacgcgcaggcagcgucggcgccgaagcgugccuaaugcuuaaaggagucaaagaagaucaaaccaaauuucuaaaaaucaaaacugugagcucagaacucucaugcagagaaggacaaagcuacuggaccggaucauuuucuccuaaaugccugagcucucgcagaugccaccucguaggagagugccaugucaaccgcugucucucuuggcgagacaacgagaccuccgcagaguucagcuucguaggugaaucaacaaccaugcgagaaaacaaaugcuucgaacaaugcgguggcugggguugcggaugcuucaacgucaaccccucaugucucuucguccacacauaccuccaaagcguucgcaaagaagcucuacgcguauucaauugcauugauuggguacauaagcucacacuagaaaucacggacuuugacggcucagucucaaccaucgaucucggugcauccaguucgcgcuucacuaacuggggaagcgucucgcuuucccucgaugccgaaggcauauccggaucgaacucauucucguucauugaaucacccggcaaaggcuacgccaucguagaugaacccuucagugaaaucccgagacaaggauuccuaggagaaauccggugcaacuccgaaucgagcguccucuccgcacacgaauccugccuccgcgccccuaaucucaucuccuacaaaccaaugaucgaucaacucgaauguacaacaaaccugaucgaucccuucgucguguuugaacguggcucacucccccaaacccgcaaugacaaaacguucgccgcuucuaaaggcaaccggggcguccaggcuuucagcaagggcuccguccaagccgaccucacgcucauguucgacaacuucgaagucgacuucgucggagccgcuguuuccugugacgccgcauuucuaaacuuaaccgggugcuacagcugcaaugccggcgcaagaguaugccucuccaucaccucaaccggaacuggcucccuaagcgcccacaacaaagacggcucacuccacaucguccuaccaagcgaaaacggcacgaaagaccaaugccaaauccugcacuuuaccguacccgaagucgaagaggaguucauguauagcugcgacggcgacgaacgaccacuucuagucaaaggcacacucaucgccaucgaccccuucgacgaccgcagagaagcaggcggugaaucaacugugguaaaccccaaaucaggcagcuggaacuucuucgacugguucuccggacucaugagcugguucggcggcccccuuaagaccaucuuacucaucugccuauacgucgcacuauccaucggacucuucuuucuacucaucuaccucggccgcacaggccucucuaaaauguggcuagccgcaaccaagaaagcaaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17420 - RNA, 3571 nt, Artificial Sequence
  mRNA product Design2 comprising derived and/or modified sequence from RVFV(ZH-548)__DQ380206.1__IgE-leader_Gn(delSP)-Gc-variant1 (opt11)
ggggcgcugccuacggagguggcagccaucuccuucucggcaucaagcuuaccauggacuggaccuggauacuguuccucguagccgccgcuacccgcguccauagugaagacccacaccuaagaaaccgccccggaaaagggcacaacuacauagaugguaugacacaagaggacgcgacguguaaacccguaaccuaugcuggagcuuguagcuccuuugauguccuucucgagaaaggaaaauucccccucuuccaauccuacgcccaccacagaacccuacucgaggcagugcaugacacaauaaucgcuaaagcagacccaccaucuugcgaucuauuaucugcucacggaaaccccugcaugaaagaaaagcuagucaugaaaacccacugccccaacgauuaccaaucagcacauuaccuuaauaacgacggcaaaauggccuccgucaaaugucccccaaaauacgaacucacagaggauugcaacuucugccgccagaugaccggcgccucccucaagaaaggguccuacccucuccaagaccuauucugccaauccuccgaagacgacggcuccaaauuaaaaacgaaaaugaaaggcgucugcgaagugggcguucaagcucucaagaaaugcgacggucaacuauccaccgcacacgaagucguucccuucgcagucuucaaaaauucuaagaaagucuaccuagacaaacuugaccuaaaaaccgaagagaaucuccuacccgacuccuucgucugcuucgaacacaaaggacaauacaaaggcaccauggauuccggccaaacaaaacgcgaacucaaauccuucgacaucucacaaugucccaaaauaggaggucacggaucgaagaaaugcaccggagacgcugccuucugcucugcauacgaaugcaccgcccaauaugccaacgccuacuguucacacgccaacggcuccggcauaguccaaauacaagucucgggcguauggaagaaaccccucugcguaggcuacgagcgagugguagucaaaagagaacucuccgccaaaccgauccaacgcgucgagccaugcacaacguguauuacaaaaugcgaaccacacgggcuaguuguccggucgaccggguucaaaaucucuucagccguagccugcgccucagguguaugcgucaccggaucacaauccccgagcaccgaaauaacccuaaaauacccggggaucagccagucguccggcggcgauaucggcguucacauggcgcacgacgaccagagcgucagcagcaaaaucgucgcccacuguccuccccaagaccccugccugguacacgacugcaucgucugcgcucacggccucauaaacuaccagugccauaccgcccuguccgccuucguugucguauucgucuucuccucaaucgccaucaucugccuagccauacuauaccgcguacucaaaugucuaaaaaucgcaccccgcaaaguacuuaacccucuaauguggaucaccgcauucauccgcuggaucuauaagaaaaugguagcccgggucgccgacaacaucaaccaagucaaccgugaaaucggauggauggaaggcggacaacucguccugggcaaccccgccccaaucccgcgacacgccccaaucccucgcuacuccaccuaccucaugcuacuacucaucguaagcuacgcuuccgcaugcuccgagcuaauccaggcuuccucccgcaucacaacuuguucaacagagggcguaaacacaaaauguagacugucuggcacagcccuaauacgugcaggaagcguaggagccgaagccugccucaugcuuaaaggaguaaaagaagaccaaacgaaauuucucaaaaucaaaacagucaguuccgagcucucaugccgcgaaggccaauccuacuggaccggcaguuucucccccaaaugccuaagcagucgccgcugccaccucgucggcgaaugccacguaaaucgauguuugucauggcgagauaaugaaaccuccgcagaguuuucauuuguaggcgaauccaccaccaugcgcgaaaacaaaugcuucgaacaaugcggagguuggggcugcggcugcuucaacgugaacccgucaugccucuucguucacaccuaucuucaauccgugcgcaaagaagcacuccgcguguuuaauugcaucgacuggguccacaaacuuacccuugaaauaacugacuucgacggcuccgucuccacaauagacuuaggagccucaucaucaagauucaccaauuggggaucaguuucccucucgcucgacgcugaagguauaaguggcaguaacucauucucauucaucgaaucacccggcaaaggcuaugcuaucguagaugagcccuuuuccgagaucccacgacaaggauuucuaggggaaauucgcuguaauucggaguccuccguccuaucggcccacgaaucaugccuccgcgccccaaaccucaucucguacaaacccaugaucgaccaguuggaaugcaccacaaaccucauugaccccuucguggucuucgaacgaggaagccucccccaaacacgcaacgacaaaaccuucgccgccucgaagggcaaccgcggcguacaagccuucaguaaaggaucgguccaagcagaccuuacccucauguucgacaacuucgaggucgacuucguuggagcggcgguguccugcgaugccgcauuccucaaccucacaggcugcuacuccugcaacgcuggagcacgcguaugcuuaucaauaaccucuacuggaacuggcucacuauccgcccacaacaaggacggcagccuccacaucguccucccaucagaaaacggcacaaaagaucagugccaaauacuccacuuuacggucccggaggucgaagaagaguucauguacagcugcgacggcgacgaacgcccccuccuaguaaaagguacccugauagcaaucgaccccuucgaugaccgccgagaggccggcggggaauccacaguggucaacccgaaauccggcagcuggaacuucuucgacugguucuccgggcuuauguccugguucggcggcccucucaaaacgauacuacuaaucugccuauacgucgcgcuguccauaggcuuauucuuccuacuaauauaccuugggcgcacuggccucucaaagauguggcuggccgccaccaagaaggccuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17421 - RNA, 3565 nt, Artificial Sequence
  mRNA product Design2 comprising derived and/or modified sequence from RVFV(ZH-548)__DQ380206.1__IgE-leader_Gn(delSP)-Gc-variant2 (opt11)
ggggcgcugccuacggagguggcagccaucuccuucucggcaucaagcuuaccauggauuggacguggauccuguuucucguggccgccgcgaccagaguccacagcccacaucucagaaaccgcccgggcaagggacacaacuacauagacggcaugacccaggaggacgcgaccugcaagcccgugaccuacgccggcgccuguagcagcuucgacguacugcuggagaagggcaaauucccccuguuccaguccuacgcacaccaccggacacugcucgaggcgguccaugacacaaucauagcuaaggccgacccucccucgugcgaccuucuauccgcgcacgggaaucccugcaugaaggagaagcucgucaugaagacccacugucccaacgacuaccagagcgcccacuaccugaacaacgacggcaaaauggccucugugaagugcccucccaaauacgagcucacagaggauugcaacuucugcaggcagaugacuggcgccucguuaaagaaagggucuuacccucugcaggaccuguucugccagagcuccgaagacgacggaagcaagcucaagacgaagaugaagggcgucugcgaggugggcgugcaggcccugaagaaaugcgacgggcagcuguccacugcccacgaggucguaccauucgcgguguucaaaaacagcaagaaagucuacuuggacaagcuggaucuuaagaccgaggagaaccuacuccccgacucuuuugugugcuucgagcauaaggggcaguauaagggcacgauggacaguggacagacaaagcgagagcugaaaaguuucgacauuagccagugcccgaaaaucggcggucacggcuccaagaagugcaccggcgacgccgccuucugcuccgccuacgaguguacugcccaguacgcgaacgccuacugcagccacgcaaaugggaguggcauagugcagauccaggucagcgggguauggaagaagccacuaugcgugggcuacgagcgcgugguggugaagcgggaacuguccgcuaagcccauccagcgcgucgagcccugcaccacuugcaucaccaagugcgagccccacgggcuggugguccggagcaccgguuucaaaauuuccagcgccgucgcgugcgcguccggugugugcgucaccgggagccagucccccagcacggagaucacccucaaguaccccggcaucucccagagcuccgggggcgacaucggggugcacauggcccacgacgaccaaucuguguccucaaagaucguggcccacugcccuccccaggaccccugccuggugcacgacugcaucgugugcgcccacggccugauaaacuaccagugccacacggcgcucagcgcguuuguuguaguguucgucuucagcuccaucgccaucaucugccuagccauucuguaccgggugcucaagugccugaagaucgcuccccggaaagugcugaauccucugauguggaucaccgccuucauccgguggaucuacaagaagaugguggcccggguugccgacaacaucaaccaagugaaccgcgagaucggcuggauggagggcgggcagcugguccuggggaacccggcccccaucccccgacacgcgcccaucccccgcuacucuacguaccucaugcugcugcucaucgugucguacgccucugcaugcagcgaguugauccaggcguccagcaggaucacaaccugcagcaccgagggcgucaacacgaagugccgccugaguggaaccgcccucauccgggcgggcuccguuggcgcugaggccugccugauguuaaaggggguaaaggaagaccaaaccaaauucuugaagaucaagaccgucagcuccgaacugagcugccgagaaggccaguccuacuggacggggucuuucagucccaagugccugagcucccgacgcugccaucucgucggugagugccacgucaaccgcugccucucauggcgggacaacgagacauccgccgaguucucauuugugggcgaguccaccaccaugcgcgagaacaagugcuuugagcagugcgguggcuggggcugcggaugcuucaacgucaaccccuccugccuguucguccauacguaccugcagagcgugcggaaggaggcccucagggucuucaacugcaucgacugggugcacaagcugacccuggagaucaccgacuucgacggcucuguguccaccauugacuugggcgcguccagcagcagauuuacgaacuggggcagcgucagucucagccuggacgccgaggggaucuccggcaguaacuccuucucguucaucgaguccccggggaagggcuacgccaucguagacgagcccuucucagagaucccccgccagggguuucucggcgagauucgcugcaacuccgaaagcucaguuuugagcgcccacgaaagcugucugcgcgcgccuaaccucaucuccuacaagcccaugaucgaccagcuggagugcacgaccaaccugaucgaccccuucguggucuucgagcggggcagccucccccagacccgcaacgacaagaccuucgccgccucaaaagggaacaggggcgugcaagccuucucaaagggguccguacaagccgaccuuacgcugauguucgacaacuuugagguugacuucgugggcgcggccguuagcugcgacgccgcguuucucaaccugaccggauguuacaguugcaaugcgggggcacgcgucugccuuucuaucaccagcaccggcacggggagccucuccgcccacaacaaggacggcucgcuacacaucguauuaccgagcgagaacgggaccaaggaccagugccagauucuccacuucaccguaccggagguggaggaggaguucauguacuccugcgacggugacgaacggccccuacugguaaaagggacccuaaucgccaucgaccccuucgacgaccgccgcgaggcgggcggcgaguccacggucgugaaccccaaaagcggguccuggaacuucuucgacugguucagcggccugaugagcugguucgggggcccguuaaagacuauccuccuuauuugccuguauguggcgcucagcaucggccuguucuuuuuauuaauauaccuggggcgcaccggccugagcaagauguggcucgcggcuacaaagaaggccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17422 - RNA, 2050 nt, Artificial Sequence
  mRNA product Design2 comprising derived and/or modified sequence from RVFV(ZH-548)__DQ380206.1__IgE-leader_Gn(delSP)-variant1 (opt11)
ggggcgcugccuacggagguggcagccaucuccuucucggcaucaagcuuaccauggacuggaccuggauccucuuccuagucgccgcagccacccgcguccacuccgaagacccacaccuacggaaccgcccaggaaaaggacacaacuacauugacggcaugacccaagaggacgcaaccugcaaaccaguaacauacgccggcgccugcuccuccuucgacguccuccuagaaaaaggcaaauucccacuauuccaauccuacgcccaccaccgaacacugcucgaagccguacacgacaccaucauagcaaaagccgacccaccuuccugcgaccuccucuccgcccacggcaaccccugcaugaaggaaaaacucgucaugaagacccacugccccaacgacuaccagagcgcccacuaccucaacaacgacggcaagauggcuagcgucaagugucccccaaaauacgaacucacugaagacugcaacuucugccgccaaaugacaggggcaucucucaagaaaggcuccuacccacuccaagaccuguucugccaaucaagcgaagacgacggauccaaacucaaaaccaaaaugaaaggagucugcgaaguuggcguccaagcccucaagaaaugcgauggccaacuaucaacagcucacgaagucguccccuucgccgucuucaaaaacucuaagaaagucuaccucgacaaacucgaccucaaaaccgaagaaaaccuacuccccgauucauucgucugcuucgaacacaaaggccaguacaaaggaaccauggacucaggccaaacaaaacgcgaacuaaaaucauucgacaucucacaaugcccaaaaaucgguggacacggcucaaagaaaugcaccggagaugcggccuucugcagcgccuacgaaugcaccgcucaauaugcaaacgccuacugcucccacgccaacggcucaggaaucguccagauccaaguauccggagucuggaagaaaccccuaugcgucggcuacgaacgcguaguaguaaaacgagaacucuccgccaaaccuauacaacgcguagaacccugcacaacaugcauaacaaaaugcgagccccacggccuagucguccgcuccaccggauucaaaauuuccucugcagucgcaugcgccucaggagucugcgucacaggcucacaaucgcccucaaccgaaaucacucucaaauacccaggcaucagccaaagcuccggcggagacaucggaguccacauggcccacgacgaccaauccgucuccagcaaaauaguggcacacugcccuccacaggaucccugccucguucacgacugcaucgucugcgcccacggccucauaaacuaccaaugccacaccgcccucuccgcguucgucgucguuuucguauucucguccaucgcaaucaucugccuugcaauccucuaccggguccucaaaugucuaaaaaucgcaccccgaaaaguccucaacccucuaauguggauaacagccuucauaagauggaucuacaagaaaauggucgcccgcguagccgacaacaucaaccaggucaaccgagaaaucggcuggauggaaggaggccaacucguccucggcaacccagccccuaucccacgacacgcacccaucccccgcuacuccaccuaccucaugcuccuacucauaguauccuacgccuccgccuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17423 - RNA, 2044 nt, Artificial Sequence
  mRNA product Design2 comprising derived and/or modified sequence from RVFV(ZH-548)__DQ380206.1__IgE-leader_Gn(delSP)-variant2 (opt11)
ggggcgcugccuacggagguggcagccaucuccuucucggcaucaagcuuaccauggacuggaccuggauccucuuccucgucgcugcagcaacacgcguccacucgccacaccuucgcaacagaccaggcaaaggccacaacuacauagacggaaugacacaagaagacgcaaccugcaaacccgucacauacgccggcgcaugcucauccuucgacguccuacuagaaaagggcaaauucccccuauuccaauccuacgcccaccaccgaacccuccuagaagccguccacgacaccaucauagcaaaggccgauccucccuccugcgaccugcugucagcacacggcaaucccugcaugaaagaaaagcuagucaugaaaacacacugccccaacgacuaccaaagcgcccacuaucucaacaacgacggcaaaauggcaucagucaaaugcccacccaaauacgaacugaccgaagacuguaacuucugccgccaaaugaccggcgccucucucaagaaaggaucauacccccuccaagaccuauucugccaauccagugaagacgacggauccaaacucaaaaccaaaaugaaaggcgucugcgaaguuggagugcaggcccucaagaaaugcgacggccaacuuuccaccgcccaugagguaguacccuucgccguauucaaaaacucgaagaaaguauaccuagacaaacucgacuuaaaaaccgaagaaaaccuccuccccgacucauucgucugcuucgaacacaaaggccaauacaaaggcaccauggacuccggacaaaccaaacgcgaacucaaauccuucgacaucagccaaugucccaaaauaggaggacacggcagcaagaaaugcaccggcgacgccgcauuuugcucagccuacgaaugcacagcacaauacgcaaacgcauacugcucacacgcaaacggcuccggaaucguccaaauccaaguauccgguguuuggaagaaaccccucugcgucggauacgaacgcgucguugucaaaagagaacucucagccaaaccaauccaacgcgucgaacccugcacaaccugcaucaccaaaugcgaaccucacgggcuagucguccgauccaccgguuucaaaaucucaagcgccgucgccugugccagcgguguaugcguaaccggaucccaaucuccaucaaccgaaaucacucuaaaauaccccggaauaagccaguccuccggaggagacauaggcguccacauggcacacgacgaccaaucagucucauccaaaauaguagcacacugcccgccacaagacccaugccuaguccacgauugcaucgucugcgcccacggccuaaucaacuaucaaugccacaccgcacucagcgcauucguggucgucuucgucuucuccagcaucgcaaucauaugccucgccauccucuaccgcguacucaaaugccuaaaaauagccccucgaaaaguucucaacccccucauguggaucaccgcuuuuauccgauggaucuacaagaaaaugguagcucgagucgccgauaacaucaaccaaguaaaccgcgaaaucggauggauggaaggcggccaacucguccuaggaaauccggcccccauaccuagacacgcacccaucccucgcuacucaaccuaccuuaugcuacuccuuauaguaucuuacgcauccgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17424 - RNA, 1960 nt, Artificial Sequence
  mRNA product Design2 comprising derived and/or modified sequence from RVFV(ZH-548)__DQ380206.1__IgE-leader_Gc (opt11)
ggggcgcugccuacggagguggcagccaucuccuucucggcaucaagcuuaccauggacuggacauggauccucuuccucguggccgcagccacaagaguccacucgugcuccgaacuuauccaagccuccagccgaaucacaaccugcagcaccgaaggcguaaauaccaaaugccgacucuccggcaccgcccuaauccgcgcaggcucaguaggcgccgaagccugccuuaugcucaaaggagucaaagaagaccaaaccaaauuccucaaaaucaagaccguaagcagcgaacuaagcugccgagaaggccagagcuauuggacaggcucauucucacccaaaugccucaguucccgcagaugccaccuagucggcgaaugccacgucaaccggugccucucauggcgggacaacgaaaccagcgcggaauuuagcuucguaggagaaucaacuaccaugcgagaaaauaagugcuucgagcaaugcggcggcuggggaugcggcugcuucaacguaaaccccucaugccuauucguccacacauaccuccaauccguccgcaaggaagcccuacgcgucuuuaacugcauugacugggugcacaaacuuacacucgaaaucacggacuucgacggcagcgucagcacaauagaccucggcgccuccagcucccgcuucaccaauuggggcuccguaagccucucccuggacgcagaaggcaucucaggcuccaauucguucuccuucauagaaucaccugggaaaggcuacgccaucguagacgaacccuucagcgaaauuccacgccaaggcuuccuaggagaaauccgcugcaacucugaaucaagcguacucuccgcccacgaauccugucuacgcgcccccaaucuaaucagcuacaaacccaugauugaccaacucgaaugcacaaccaauuuaaucgacccauuugucgucuucgagcgcggaucacuaccacaaacccgaaacgacaaaaccuucgcagcaagcaagggaaaccgcgguguacaagccuucagcaaaggcuccguccaagcagaccuuacacuaauguucgacaacuucgaagucgacuucgucggcgccgccgucagcugcgacgccgccuuccugaaccucacgggcuguuacagcugcaacgccggcgcacgcgucugccuaucuaucaccucgaccggcacaggaucacuauccgcacacaacaaagacggaucgcuccacaucguacucccaagcgaaaacggcaccaaggaccagugccaaauccugcacuucaccguaccagaaguagaagaagaguucauguacucaugcgacggcgacgaaagaccacugcucgugaaaggcacccuuauagcgaucgacccauucgacgaccgacgagaagcaggaggcgaaucaacaguuguaaaccccaaaagcggaaguuggaacuucuucgacugguucagcgggcucaugagcugguucggaggaccacucaaaaccauacuccucaucugccucuacgucgcacucagcaucgggcuuuucuuccuccucaucuaccugggccgcaccggacuaucaaaaauguggcucgccgccaccaagaaagcaagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17425 - protein, 245 aa, Artificial Sequence; identical to SEQ ID NO: 877
  derived and/or modified protein sequence (wt) from SFTSV(HB29)__NC_018137.1__N

SEQ ID NO: 17426 - protein, 1073 aa, Artificial Sequence; identical to SEQ ID NO: 2357
  derived and/or modified protein sequence (wt) from SFTSV(HB29)__NC_018138.1__GP

SEQ ID NO: 17427 - protein, 1072 aa, Artificial Sequence
  derived and/or modified protein sequence (wt) from SFTSV(HB29)__NC_018138.1__IgE-leader_Gn-Gc
MDWTWILFLVAAATRVHSDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGTRVRPKCYGFSRMMATLEVNPPEQRIGQCTGCHLECINGGVRLITLTSELRSATVCASHFCSSASSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVRLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 17428 - RNA, 738 nt, Artificial Sequence; identical to SEQ ID NO: 3212
  derived and/or modified CDS sequence (wt) from SFTSV(HB29)__NC_018137.1__N

SEQ ID NO: 17429 - RNA, 3222 nt, Artificial Sequence; identical to SEQ ID NO: 4692
  derived and/or modified CDS sequence (wt) from SFTSV(HB29)__NC_018138.1__GP

SEQ ID NO: 17430 - RNA, 3222 nt, Artificial Sequence
  derived and/or modified CDS sequence (wt) from SFTSV(HB29)__NC_018138.1__GP
augaugaaagucaucugguucuccucucugaucugcuuagucauucaaugcaguggggauucgggcccaaucaucugcgcaggacccauccacucaaacaagagugcuggcauaccccaccuccuugguuacucugagaagauuugucagauagaucggcugauacauguuucgucauggcucaggaaccacucgcaauuucaaggcuacguugggcagcgagguggacgcucucagguuagcuacuacccagcugagaacucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaguucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggacgcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaguucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcagagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagaacucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacaaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagugggugcuauuccugcaugacaggugccaaagucuccaucaaauugcauagcagcaaaaauagcacugcccauguuagaugcaaaggggaugagacugcauucagugucuuggagggaguccauagcuacauuguccgccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 17431 - RNA, 3219 nt, Artificial Sequence
  derived and/or modified CDS sequence (wt) from SFTSV(HB29)__NC_018138.1__IgE-leader_Gn-Gc
auggacuggaccuggauccuguuccucguggccgccgcgacccgcguccacagcgauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggacgcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcagagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagugggugcuauuccugcaugacaggugccaaagucuccaucaaauugcauagcagcaaaaauagcacugcccauguuagaugcaaaggggaugagacugcauucagugucuuggagggaguccauagcuacauuguccgccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 17432 - RNA, 3219 nt, Artificial Sequence
  derived and/or modified CDS sequence (wt) from SFTSV(HB29)__NC_018138.1__IgE-leader_Gn-Gc
auggacuggaccuggauccuguuccucguggccgccgcgacccgcguccacagcgauucgggcccaaucaucugcgcaggacccauccacucaaacaagagugcuggcauaccccaccuccuugguuacucugagaagauuugucagauagaucggcugauacauguuucgucauggcucaggaaccacucgcaauuucaaggcuacguugggcagcgagguggacgcucucagguuagcuacuacccagcugagaacucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaguucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggacgcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaguucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcagagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagaacucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacaaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagugggugcuauuccugcaugacaggugccaaagucuccaucaaauugcauagcagcaaaaauagcacugcccauguuagaugcaaaggggaugagacugcauucagugucuuggagggaguccauagcuacauuguccgccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuag

SEQ ID NO: 17433 - RNA, 738 nt, Artificial Sequence; identical to SEQ ID NO: 5547
  derived and/or modified CDS sequence (opt4) from SFTSV(HB29)__NC_018137.1__N

SEQ ID NO: 17434 - RNA, 3222 nt, Artificial Sequence; identical to SEQ ID NO: 9795
  derived and/or modified CDS sequence (opt4) from SFTSV(HB29)__NC_018138.1__GP

SEQ ID NO: 17435 - RNA, 3219 nt, Artificial Sequence
  derived and/or modified CDS sequence (opt4) from SFTSV(HB29)__NC_018138.1__IgE-leader_Gn-Gc
auggacuggaccuggauccuguuccugguggccgccgccaccagagugcacagcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaccagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccagcagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagacugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 17436 - RNA, 738 nt, Artificial Sequence; identical to SEQ ID NO: 6239
  derived and/or modified CDS sequence (opt3) from SFTSV(HB29)__NC_018137.1__N

SEQ ID NO: 17437 - RNA, 3222 nt, Artificial Sequence; identical to SEQ ID NO: 11438
  derived and/or modified CDS sequence (opt3) from SFTSV(HB29)__NC_018138.1__GP

SEQ ID NO: 17438 - RNA, 3219 nt, Artificial Sequence
  derived and/or modified CDS sequence (opt3) from SFTSV(HB29)__NC_018138.1__IgE-leader_Gn-Gc
auggacuggaccuggauccuguuccucguggccgcugcaacaagaguccacagcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggacaagggugcggcccaaauguuacggcuucagucgcaugauggccacccuggaggucaacccuccagaacagcgaaucggacaaugcacuggcugucaccuugagugcaucaaugggggagugagauugauuacacugaccagcgagcuaagguccgcuacgguuugugccucucauuuuugcucgagcgcguccucagguaagaagaguacugaaauacacuuccacucuggcagccucguggggaaaaccgcaauccaugucaagggagcccugguggacggcacagaguucacuuuugaagguuccuguauguuccccgaugggugcgacgcuguagauugcaccuuuugucgggaguuccuuaaaaacccgcagugcuauccugccaagaaauggcuguuuauuaucauaguuauuuugcucggcuacgcaggacugauguuacugacaaaugugcucaaggcuaucggcgucugggggucaugggugaucgcccccgucaaacuuauguucgcgauuaucaagaagcugaugcguaccgugagcuguuugguuggaaaacuaauggaccgcgguagacaggugauucacgaagagauaggcgagaacggggaaggaaaucaagaugacguaaggaucgagauggcccggccacgacgcgucagacauuggauguauucuccugugauucugacgauccucgcaaucggccuggcugaagguugcgaugagaugguucacgccgacuccaaacuugugaguuguaggcaggggagcggcaacaugaaggagugcauuacuacaggacgggcucuguugcccgccgucaauccaggccaggaagcaugucuccauuuuaccgcccccgggucuccugauuccaagugccugaagauaaaagugaagcgcaucaacuuaaaauguaagaaaucaaguagcuacuucguaccagacgcuagaucgaggugcacuuccgugcgucggugucgaugggcgggagauugccagucuggcugcccgccccacuuuacaagcaauucauucagugacgacugggcagguaagauggauagagccgggcugggauuuuccggcuguucugacgguugcggcggggcugccuguggaugcuucaacgcagccccuagcuguaucuuuuggaggaaguggguugagaauccacacggcauuauuuggaaagucucccccugcgcugccugggugccuucagcagugaucgaacuaaccaugccaagcggggagguccgcacguuccaucccaugaguggaauaccgacccaaguuuucaagggcgugucugugacauaucucgguuccgauauggaaguaagcgggcugacugaccuuugugagaucgaggaauugaaaucgaagaaacuggcgcucgcuccuugcaaccaggccggaaugggcgucguggguaagguuggcgagauucaguguucaucugaagagagugcacggaccaucaaaaaggaugggugcauuuggaacgccgaccuggugggaaucgaacuuagagucgaugacgcuguguguuacuccaagauaacaagcguugaggccguggcaaauuauucugcuauuccaacuaccaucggcgggcugagguuugagcgcagccacgauucccagggaaaaauuucaggcagucccuuggacaucacagccauacgagguagcuucucuguaaacuaccgggggcuccgucuguccuuaucagaaaucaccgcgacuugcacgggagaggucacaaaugugaguggcugcuacagcuguaugaccggugccaagguguccauuaaacugcauucuucgaagaacagcacugcucacgucagaugcaaaggcgaugaaaccgcauuuucaguucuagagggggugcacuccuauaucguaaggcucaguuucgaccaugccguggucgaugaacaaugucagcugaauugcggaggccacgagucucaggugacacuuaaggggaacuugauuuuucuggacguuccuaaguucguggacggaagcuacaugcagaccuaucauuccacuguccccacaggcgcuaauaucccaucaccuacggauuggcucaacgcccuguuugguaauggguuaucucgcuggauacugggagugauuggcguucuuuugggcgggcucgcacuguucuuucuaaucauguuccugcucaaacugggaaccaagcaaguguuucggagcagaacuaaacuugcguga

SEQ ID NO: 17439 - RNA, 738 nt, Artificial Sequence; identical to SEQ ID NO: 6931
  derived and/or modified CDS sequence (opt1) from SFTSV(HB29)__NC_018137.1__N

SEQ ID NO: 17440 - RNA, 3222 nt, Artificial Sequence; identical to SEQ ID NO: 13081
  derived and/or modified CDS sequence (opt1) from SFTSV(HB29)__NC_018138.1__GP

SEQ ID NO: 17441 - RNA, 3219 nt, Artificial Sequence
  derived and/or modified CDS sequence (opt1) from SFTSV(HB29)__NC_018138.1__IgE-leader_Gn-Gc
auggacuggaccuggauccuguuccucguggccgccgcgacccgcguccacagcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcacccggguccgcccgaagugcuacggguucagccggaugauggcgacccuggaggugaacccgcccgagcagcgcaucggccagugcacggggugccaccucgagugcaucaacggcggggugcggcugaucacccugaccuccgagcuccgcagcgccaccgucugcgccucccacuucugcagcuccgccagcuccggcaagaaguccacggagauccacuuccacuccggcagccugguggggaagaccgccauccacgucaagggcgcgcugguggacgggaccgaguucaccuucgagggcuccugcauguuccccgacggcugcgacgccguggacugcacguucugccgggaguuccucaagaacccccagugcuaccccgccaagaaguggcuguucaucaucaucgucauccugcucggguacgccggccugaugcugcucaccaacgugcugaaggccaucgggguguggggcagcugggucaucgcgcccgugaagcugauguucgccaucaucaagaagcucaugcgcaccguguccugccuggucgggaagcugauggaccggggccgccaggugauccacgaggagaucggcgagaacggggagggcaaccaggacgacgugcggaucgagauggcccgcccccgccggguccgccacuggauguacagcccggugauccucaccauccuggccaucgggcuggccgagggcugcgacgagauggugcacgcggacuccaagcucgucagcugccggcagggguccggcaacaugaaggagugcaucacgaccggccgcgcccugcugcccgccgugaaccccgggcaggaggccugccuccacuucaccgcccccggcagcccggacagcaagugccugaagaucaaggugaagcggaucaaccugaagugcaagaaguccagcuccuacuucguccccgacgcgcgcagccggugcaccuccgugcgccggugccgcugggccggggacugccagagcggcugcccgccccacuucacguccaacagcuucuccgacgacugggccgggaagauggaccgggccggccucggcuucagcgggugcuccgacggcugcgggggcgcggccugcgggugcuucaacgccgcccccagcugcaucuucuggcgcaaguggguggagaacccccacggcaucaucuggaaggucucccccugcgccgcgugggugccgagcgccgugaucgagcugaccaugcccuccggcgagguccggaccuuccaccccaugagcgggauccccacccagguguucaagggcguguccgucacguaccuggggagcgacauggagguguccggccucaccgaccugugcgagaucgaggagcucaagagcaagaagcuggcccuggccccgugcaaccaggccggcauggggguggucggcaaggugggggagauccagugcagcuccgaggagagcgcgcgcaccaucaagaaggacggcugcaucuggaacgccgaccugguggggaucgagcugcgggucgacgacgccgugugcuacuccaagaucaccagcguggaggccgucgccaacuacuccgcgauccccacgaccaucggcggccuccgcuucgagcggagccacgacucccaggggaagaucagcggcagcccccuggacaucaccgccauccgcgggagcuucuccgugaacuaccggggccugcgccucagccuguccgagaucaccgccacgugcaccggggaggugaccaacgucagcggcugcuacuccugcaugaccggcgccaaggugagcaucaagcugcacuccagcaagaacuccaccgcgcacgugcgcugcaagggggacgagacggccuucagcguccucgagggcgugcacagcuacaucgugcggcuguccuucgaccacgccgucguggacgagcagugccagcugaacugcgggggccacgagagccaggugacccucaaggggaaccugaucuuccuggacguccccaaguucguggacggcuccuacaugcagaccuaccacagcaccgugccgacgggcgccaacauccccucccccaccgacuggcucaacgcccuguucgggaacggccugagccgcuggauccucggggucaucggcgugcugcugggcgggcucgcgcuguucuuccugaucauguuccuccugaagcugggcaccaagcaggucuuccggucccgcaccaagcucgccuga

SEQ ID NO: 17442 - RNA, 738 nt, Artificial Sequence; identical to SEQ ID NO: 7623
  derived and/or modified CDS sequence (opt5) from SFTSV(HB29)__NC_018137.1__N

SEQ ID NO: 17443 - RNA, 3222 nt, Artificial Sequence; identical to SEQ ID NO: 14724
  derived and/or modified CDS sequence (opt5) from SFTSV(HB29)__NC_018138.1__GP

SEQ ID NO: 17444 - RNA, 3219 nt, Artificial Sequence
  derived and/or modified CDS sequence (opt5) from SFTSV(HB29)__NC_018138.1__IgE-leader_Gn-Gc
auggacuggaccuggauccuguuccucguggccgcugccacaagaguccacagcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaggcuucugaagccaaaugucggugcucccuggugcauaagccuggggaaguggucgugagcuacggaggcacacgcguuagacccaaauguuacggguucucccggaugauggcgacccuugaggugaacccucccgaacagcgcaucggacaaugcacgggcugucaccuggagugcauuaaugggggcgucagacucaucacccugacaucugagcugcggagcgccaccgugugugcuucccauuuuugcucuagcgccuccagcggaaagaagucuacagaaauucacuuccacuccggcagccucguugggaaaaccgcuauccaugugaagggagcccuggucgacggcacggaguucacauuugaagggucuuguauguuccccgauggaugcgacgcgguggauugcaccuuuugucgcgaguuccuuaaaaacccucagugcuauccggccaagaaauggcuguuuaucauuaucgucauucuccugggcuacgcugggcuuaugcugcucacaaaugugcugaaggccaucggcguuuggggauccugggugauugcucccgucaagcugauguucgccaucaucaaaaagcucaugagaaccgugagcugucugguuggcaaacuuauggaccgggggagacaggugauucacgaagagaucggagagaacggcgaagggaaucaagaugacguccgcauugagauggcccggccuagacgcgugcggcauuggauguauucucccgugauccugaccauucucgcuaucggacuggcggaaggcugcgaugagaugguucacgccgacagcaagcuggucuccuguagacaggggagcggcaacaugaaagagugcauuacaacgggacgcgcucugcucccugccgugaaucccggccaggaagccugucugcauuuuaccgcuccggggucuccugauuccaagugccugaagaucaaagugaagcggaucaaccucaaauguaagaaaagcuccucuuacuucguccccgacgccagaagccgcugcacauccgugcggagaugucgcugggcgggagauugccagucuggcugcccuccccacuuuaccagcaauuccuucucugacgacugggcugggaagauggaucgggccggacugggcuuuagcggguguuccgacggcugcggaggcgccgcuugugggugcuucaacgccgcuccuagcuguaucuuuuggagaaaguggguugagaauccccacggaauuauuuggaaagugucuccgugcgccgcgugggucccuuccgccgugaucgaacuuacaaugcccagcggcgagguucggaccuuccaucccaugucugggauuccuacgcaaguguucaagggagucuccgugacauaucugggcagcgauauggaaguuucuggccucaccgaccugugugagaucgaggaacugaaauccaagaaacuugcucucgccccgugcaaccaggcugggaugggaguggucggcaaggugggggagauccaguguagcuccgaagagagcgcccgcaccauuaaaaaggauggaugcaucuggaacgcggaccuggugggcauugaacugagagucgaugacgccguuuguuacucuaagaucacaagcguggaggcuguggccaauuauuccgcuauucccaccacaaucgggggacuccgguuugagagaucucacgauagccagggcaaaaucuccggcucuccucuggacauuacggccauccgcgggagcuucuccgucaacuaccggggacuuagacugucucucagcgaaauuaccgccacaugcaccggcgaggugacaaauguuuccgggugcuacagcuguaugaccggagcuaaggugucuaucaaacugcauuccagcaagaacucuacggcgcacguccgcugcaaaggcgaugaaaccgccuuuuccgugcuggaggggguucacagcuauauugugagacuuuccuucgaccaugcugucguggaugaacaaugucagcucaauugcggaggccacgagucucagguuacacugaagggcaaccugaucuuucucgacgugcccaaguucgucgacgggagcuacaugcagaccuaucauuccacagugccuaccggagccaauauccccagcccuacggauuggcugaacgcccuuuuuggcaaugggcugucucgguggauucucggagugaucggcguccugcuugggggacuugcucucuucuuucugauuauguuccugcucaaacugggcacaaagcaaguuuuucgcuccagaaccaaacuugccuga

SEQ ID NO: 17445 - RNA, 738 nt, Artificial Sequence; identical to SEQ ID NO: 8315
  derived and/or modified CDS sequence (opt11) from SFTSV(HB29)__NC_018137.1__N

SEQ ID NO: 17446 - RNA, 3222 nt, Artificial Sequence; identical to SEQ ID NO: 16367
  derived and/or modified CDS sequence (opt11) from SFTSV(HB29)__NC_018138.1__GP

SEQ ID NO: 17447 - RNA, 3219 nt, Artificial Sequence
  derived and/or modified CDS sequence (opt11) from SFTSV(HB29)__NC_018138.1__IgE-leader_Gn-Gc
auggauuggacguggauacucuuucucguggccgcggccacgcgcgugcacucggacuccgggcccaucauaugcgcaggccccauccacagcaacaaaucagcagggauaccccaccuccucggauacucagagaaaauaugccaaauagacagauuaauccacgugagcuccuggcugcggaaccacucucaauuccaaggguacgucggucaacgagggggaagaagccaagucucauacuacccagcagaaaacagcuacuccagauggagcggauuacuaucgccuugcgacgcagacuggcuaggcaugcuaguaguaaagaaagccaaagaauccgacaugaucgugccaggccccucuuacaaaggaaaaguauuuuucgaaaggccaacauucgacggauacgucggcuggggcugcggcuccggaaaaagcaggacugagagcggggagcuauguucaucagacagcggcacgucgagcggccuccucccaucagaccggguccuguggaucggagacgucgccugccaacccaugaccccgauaccagaagagacauuccuagagcuaaagagcuucucccaaagcgaguuccccgacauaugcaaaauagacggcauagucuucaaucaaugcgagggagaaucccucccucagccuuucgaugucgcauggauggacguggggcacucacauaaaauuaucaugcgagaacacaaaacgaaauggguccaggaauccagcagcaaagauuucguaugcuauaaagaaggaacaggacccugcucagaaucagaggaaaaagccugcaaaaccucaggcucgugcagaggugacaugcaguucuguaaagucgccggaugcgaacacggggaagaagcaagcgaggccaaaugccgcugcagccuuguccacaagccaggagaaguagucgucuccuacggcggcaccaggguccgccccaaaugcuacggcuucuccagaaugauggccacccucgaagucaacccgcccgaacaacgcaucggacaaugcacaggcugccaccucgaaugcauaaacggcggagugagacugaucacccuaaccuccgagcuccggagcgccaccgugugugcaucccacuucugcagcuccgccucaagcggcaaaaagaguaccgaaauccacuuccacucgggaagccugguaggaaaaacagccauccaugugaaaggagcccucguagacggaacagaguucacauucgaaggaagcugcauguucccugacggcugcgacgccguagacugcaccuuuugccgagaguuccucaaaaacccccaaugcuaucccgccaagaaauggcuuuuuaucauaauuguaaucuugcucggcuacgccggccuaaugcuacucaccaacgugcucaaagccauaggaguaugggggucaugggucaucgccccagugaaacuaauguucgcaauaaucaaaaagcuaaugcgaacgguaucaugccuagucggaaaacuaauggacagaggacgccaaguaauacacgaagaaaucggggagaacggggaggguaaccaggacgacguccgaauagagauggcgaggccccggagagugcgccacuggauguacagcccaguaauacuaaccauucuagccauaggacuggcugaaggaugugaugaaaugguacaugccgauagcaaacugguauccugccggcaaggauccggaaacaugaaggaaugcaucacaacagggagagcccugcuaccggcaguaaacccuggacaagaagcaugccugcacuuuaccgcgccggggagccccgacagcaaaugccucaagauaaaggucaagcgaauaaaccuaaaaugcaagaaaucuagcaguuacuucguaccagacgcaagaagcagaugcaccucaguucgacggugccgcugggccggugacugccaguccggcuguccgccccauuucacgagcaacagcuucagugacgacugggcaggcaaaauggacagagcuggacucggcuucagcggcugcagcgacggcugugggggagcggccugcgggugcuuuaacgcagcaccuagcugcaucuucuggcgaaagugggucgaaaacccacacgggauaauauggaaggucagccccugcgcagcauggguaccauccgccgucauagaauuaacaaugccguccggcgaaguucgcacauuccaucccaugucaggcauaccaacccaggucuuuaaaggcgucucaguaaccuaccuaggaucagacauggagguaagcggacuuacagaccucugugaaauagaggaacucaagagcaagaaacucgcacucgcgccuugcaaccaggcaggcaugggcguagucggcaaaguuggggaaauccagugcucaagcgaagaaagcgcccgcaccaucaagaaagacggaugcaucuggaacgcggaucuagucggaaucgagcuacgcguugaugacgccguaugcuacagcaaaaucaccucaguagaggccgucgcaaacuacuccgccauacccacaacuauaggcggucucagguucgagcgcucccacgacucccagggaaaaauaucaggcucgccccuagacauaaccgccauccgaggcucauucucagucaacuaccgcggccuucgccucagccucuccgaaauuacggcaaccugcaccggagaaguaacgaacgucucagguugcuauucgugcaugaccggagccaaagucagcauaaaacugcacuccagcaaaaacucaacagcgcacguacgaugcaaaggcgacgaaacagcauucucaguacuugaaggaguccacuccuacaucguuaggcuauccuuugaccaugccgucgucgacgaacaaugucaacuaaacugcgggggacacgaaucgcaagugacucuaaaaggaaaccugauauuucucgacgucccgaaauucguagacgggucuuauaugcagacauaccacagcacgguaccaacuggagccaacauaccaucacccacagacuggcugaacgcucuauucggaaacggccucucaagguggauacuaggggucauaggcguucuccuaggaggccucgcacuauucuuccuaaucauguuucugcucaaacucggcacaaagcaaguauucagaagccgaacuaaacuagcguga

SEQ ID NO: 17448 - RNA, 955 nt, Artificial Sequence
  mRNA product Design1 comprising derived and/or modified sequence from SFTSV(HB29)__NC_018137.1__N (wt)
gggagaaagcuuaccaugucggagugguccaggauugcaguggaguuuggugagcagcagcucaauuugacugagcuugaggacuucgcgagagagcuggccuaugaaggccuugacccugcuuugaucaucaagaagcugaaggagacagguggagaugauugggugaaggauacaaaguucaucauugucuuugcccugacucgaggcaauaagaucgucaaggcaucagggaaaaugucaaacucaggguccaagagguugauggcacuccaagagaaauauggacugguugagagggcagagaccaggcucucaaucacuccagugaggguugcgcagagccuucccacuuggacaugugcugcugcagcagcucuaaaggaguaucucccaguagggccagccgucaugaaccugaagguugagaauuaucccccugagaugaugugcauggccuuuggaucccugauuccaacugcggggguaucugaagccacaaccaagacccugauggaggccuacucucuguggcaagaugccuucaccaagacuaucaauguaaagaugcgcggagccagcaagacagaaguuuacaacuccuucagggacccucuucaugcugcugugaacucugucuucuuucccaaugauguucggguaaaguggcugaaggccaaggggauccuuggcccagaugggguccccagcagagcugcugagguugcugcugcugcuuacagaaaccuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17449 - RNA, 3439 nt, Artificial Sequence
  mRNA product Design1 comprising derived and/or modified sequence from SFTSV(HB29)__NC_018138.1__GP (wt)
gggagaaagcuuaccaugaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggacgcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcagagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagugggugcuauuccugcaugacaggugccaaagucuccaucaaauugcauagcagcaaaaauagcacugcccauguuagaugcaaaggggaugagacugcauucagugucuuggagggaguccauagcuacauuguccgccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17450 - RNA, 3439 nt, Artificial Sequence
  mRNA product Design1 comprising derived and/or modified sequence from SFTSV(HB29)__NC_018138.1__GP (wt)
gggagaaagcuuaccaugaugaaagucaucugguucuccucucugaucugcuuagucauucaaugcaguggggauucgggcccaaucaucugcgcaggacccauccacucaaacaagagugcuggcauaccccaccuccuugguuacucugagaagauuugucagauagaucggcugauacauguuucgucauggcucaggaaccacucgcaauuucaaggcuacguugggcagcgagguggacgcucucagguuagcuacuacccagcugagaacucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaguucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggacgcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaguucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcagagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagaacucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacaaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagugggugcuauuccugcaugacaggugccaaagucuccaucaaauugcauagcagcaaaaauagcacugcccauguuagaugcaaaggggaugagacugcauucagugucuuggagggaguccauagcuacauuguccgccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17451 - RNA, 3436 nt, Artificial Sequence
  mRNA product Design1 comprising derived and/or modified sequence from SFTSV(HB29)__NC_018138.1__IgE-leader_Gn-Gc (wt)
gggagaaagcuuaccauggacuggaccuggauccuguuccucguggccgccgcgacccgcguccacagcgauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggacgcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcagagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagugggugcuauuccugcaugacaggugccaaagucuccaucaaauugcauagcagcaaaaauagcacugcccauguuagaugcaaaggggaugagacugcauucagugucuuggagggaguccauagcuacauuguccgccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17452 - RNA, 3436 nt, Artificial Sequence
  mRNA product Design1 comprising derived and/or modified sequence from SFTSV(HB29)__NC_018138.1__IgE-leader_Gn-Gc (wt)
gggagaaagcuuaccauggacuggaccuggauccuguuccucguggccgccgcgacccgcguccacagcgauucgggcccaaucaucugcgcaggacccauccacucaaacaagagugcuggcauaccccaccuccuugguuacucugagaagauuugucagauagaucggcugauacauguuucgucauggcucaggaaccacucgcaauuucaaggcuacguugggcagcgagguggacgcucucagguuagcuacuacccagcugagaacucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaguucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggacgcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaguucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcagagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagaacucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacaaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagugggugcuauuccugcaugacaggugccaaagucuccaucaaauugcauagcagcaaaaauagcacugcccauguuagaugcaaaggggaugagacugcauucagugucuuggagggaguccauagcuacauuguccgccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17453 - RNA, 955 nt, Artificial Sequence
  mRNA product Design1 comprising derived and/or modified sequence from SFTSV(HB29)__NC_018137.1__N (opt4)
gggagaaagcuuaccaugagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17454 - RNA, 3439 nt, Artificial Sequence
  mRNA product Design1 comprising derived and/or modified sequence from SFTSV(HB29)__NC_018138.1__GP (opt4)
gggagaaagcuuaccaugaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaccagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccagcagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagacugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17455 - RNA, 3436 nt, Artificial Sequence
  mRNA product Design1 comprising derived and/or modified sequence from SFTSV(HB29)__NC_018138.1__IgE-leader_Gn-Gc (opt4)
gggagaaagcuuaccauggacuggaccuggauccuguuccugguggccgccgccaccagagugcacagcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaccagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccagcagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagacugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17456 - RNA, 955 nt, Artificial Sequence
  mRNA product Design1 comprising derived and/or modified sequence from SFTSV(HB29)__NC_018137.1__N (opt3)
gggagaaagcuuaccaugagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucucagaggcuaccacuaaaacauuaauggaagccuacagccuguggcaggaugcauuuaccaagacgauaaaugugaagaugaggggcgcuaguaaaacugagguauauaacuccuuccgggacccucuucacgccgcgguuaauucuguguuuuucccaaacgauguccgcgugaagugguugaaagccaagggcauccuggggcccgacggagugccuagcagagcagcugaagucgccgcugccgcauacaggaaucuaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17457 - RNA, 3439 nt, Artificial Sequence
  mRNA product Design1 comprising derived and/or modified sequence from SFTSV(HB29)__NC_018138.1__GP (opt3)
gggagaaagcuuaccaugaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggacaagggugcggcccaaauguuacggcuucagucgcaugauggccacccuggaggucaacccuccagaacagcgaaucggacaaugcacuggcugucaccuugagugcaucaaugggggagugagauugauuacacugaccagcgagcuaagguccgcuacgguuugugccucucauuuuugcucgagcgcguccucagguaagaagaguacugaaauacacuuccacucuggcagccucguggggaaaaccgcaauccaugucaagggagcccugguggacggcacagaguucacuuuugaagguuccuguauguuccccgaugggugcgacgcuguagauugcaccuuuugucgggaguuccuuaaaaacccgcagugcuauccugccaagaaauggcuguuuauuaucauaguuauuuugcucggcuacgcaggacugauguuacugacaaaugugcucaaggcuaucggcgucugggggucaugggugaucgcccccgucaaacuuauguucgcgauuaucaagaagcugaugcguaccgugagcuguuugguuggaaaacuaauggaccgcgguagacaggugauucacgaagagauaggcgagaacggggaaggaaaucaagaugacguaaggaucgagauggcccggccacgacgcgucagacauuggauguauucuccugugauucugacgauccucgcaaucggccuggcugaagguugcgaugagaugguucacgccgacuccaaacuugugaguuguaggcaggggagcggcaacaugaaggagugcauuacuacaggacgggcucuguugcccgccgucaauccaggccaggaagcaugucuccauuuuaccgcccccgggucuccugauuccaagugccugaagauaaaagugaagcgcaucaacuuaaaauguaagaaaucaaguagcuacuucguaccagacgcuagaucgaggugcacuuccgugcgucggugucgaugggcgggagauugccagucuggcugcccgccccacuuuacaagcaauucauucagugacgacugggcagguaagauggauagagccgggcugggauuuuccggcuguucugacgguugcggcggggcugccuguggaugcuucaacgcagccccuagcuguaucuuuuggaggaaguggguugagaauccacacggcauuauuuggaaagucucccccugcgcugccugggugccuucagcagugaucgaacuaaccaugccaagcggggagguccgcacguuccaucccaugaguggaauaccgacccaaguuuucaagggcgugucugugacauaucucgguuccgauauggaaguaagcgggcugacugaccuuugugagaucgaggaauugaaaucgaagaaacuggcgcucgcuccuugcaaccaggccggaaugggcgucguggguaagguuggcgagauucaguguucaucugaagagagugcacggaccaucaaaaaggaugggugcauuuggaacgccgaccuggugggaaucgaacuuagagucgaugacgcuguguguuacuccaagauaacaagcguugaggccguggcaaauuauucugcuauuccaacuaccaucggcgggcugagguuugagcgcagccacgauucccagggaaaaauuucaggcagucccuuggacaucacagccauacgagguagcuucucuguaaacuaccgggggcuccgucuguccuuaucagaaaucaccgcgacuugcacgggagaggucacaaaugugaguggcugcuacagcuguaugaccggugccaagguguccauuaaacugcauucuucgaagaacagcacugcucacgucagaugcaaaggcgaugaaaccgcauuuucaguucuagagggggugcacuccuauaucguaaggcucaguuucgaccaugccguggucgaugaacaaugucagcugaauugcggaggccacgagucucaggugacacuuaaggggaacuugauuuuucuggacguuccuaaguucguggacggaagcuacaugcagaccuaucauuccacuguccccacaggcgcuaauaucccaucaccuacggauuggcucaacgcccuguuugguaauggguuaucucgcuggauacugggagugauuggcguucuuuugggcgggcucgcacuguucuuucuaaucauguuccugcucaaacugggaaccaagcaaguguuucggagcagaacuaaacuugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17458 - RNA, 3436 nt, Artificial Sequence
  mRNA product Design1 comprising derived and/or modified sequence from SFTSV(HB29)__NC_018138.1__IgE-leader_Gn-Gc (opt3)
gggagaaagcuuaccauggacuggaccuggauccuguuccucguggccgcugcaacaagaguccacagcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggacaagggugcggcccaaauguuacggcuucagucgcaugauggccacccuggaggucaacccuccagaacagcgaaucggacaaugcacuggcugucaccuugagugcaucaaugggggagugagauugauuacacugaccagcgagcuaagguccgcuacgguuugugccucucauuuuugcucgagcgcguccucagguaagaagaguacugaaauacacuuccacucuggcagccucguggggaaaaccgcaauccaugucaagggagcccugguggacggcacagaguucacuuuugaagguuccuguauguuccccgaugggugcgacgcuguagauugcaccuuuugucgggaguuccuuaaaaacccgcagugcuauccugccaagaaauggcuguuuauuaucauaguuauuuugcucggcuacgcaggacugauguuacugacaaaugugcucaaggcuaucggcgucugggggucaugggugaucgcccccgucaaacuuauguucgcgauuaucaagaagcugaugcguaccgugagcuguuugguuggaaaacuaauggaccgcgguagacaggugauucacgaagagauaggcgagaacggggaaggaaaucaagaugacguaaggaucgagauggcccggccacgacgcgucagacauuggauguauucuccugugauucugacgauccucgcaaucggccuggcugaagguugcgaugagaugguucacgccgacuccaaacuugugaguuguaggcaggggagcggcaacaugaaggagugcauuacuacaggacgggcucuguugcccgccgucaauccaggccaggaagcaugucuccauuuuaccgcccccgggucuccugauuccaagugccugaagauaaaagugaagcgcaucaacuuaaaauguaagaaaucaaguagcuacuucguaccagacgcuagaucgaggugcacuuccgugcgucggugucgaugggcgggagauugccagucuggcugcccgccccacuuuacaagcaauucauucagugacgacugggcagguaagauggauagagccgggcugggauuuuccggcuguucugacgguugcggcggggcugccuguggaugcuucaacgcagccccuagcuguaucuuuuggaggaaguggguugagaauccacacggcauuauuuggaaagucucccccugcgcugccugggugccuucagcagugaucgaacuaaccaugccaagcggggagguccgcacguuccaucccaugaguggaauaccgacccaaguuuucaagggcgugucugugacauaucucgguuccgauauggaaguaagcgggcugacugaccuuugugagaucgaggaauugaaaucgaagaaacuggcgcucgcuccuugcaaccaggccggaaugggcgucguggguaagguuggcgagauucaguguucaucugaagagagugcacggaccaucaaaaaggaugggugcauuuggaacgccgaccuggugggaaucgaacuuagagucgaugacgcuguguguuacuccaagauaacaagcguugaggccguggcaaauuauucugcuauuccaacuaccaucggcgggcugagguuugagcgcagccacgauucccagggaaaaauuucaggcagucccuuggacaucacagccauacgagguagcuucucuguaaacuaccgggggcuccgucuguccuuaucagaaaucaccgcgacuugcacgggagaggucacaaaugugaguggcugcuacagcuguaugaccggugccaagguguccauuaaacugcauucuucgaagaacagcacugcucacgucagaugcaaaggcgaugaaaccgcauuuucaguucuagagggggugcacuccuauaucguaaggcucaguuucgaccaugccguggucgaugaacaaugucagcugaauugcggaggccacgagucucaggugacacuuaaggggaacuugauuuuucuggacguuccuaaguucguggacggaagcuacaugcagaccuaucauuccacuguccccacaggcgcuaauaucccaucaccuacggauuggcucaacgcccuguuugguaauggguuaucucgcuggauacugggagugauuggcguucuuuugggcgggcucgcacuguucuuucuaaucauguuccugcucaaacugggaaccaagcaaguguuucggagcagaacuaaacuugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17459 - RNA, 955 nt, Artificial Sequence
  mRNA product Design1 comprising derived and/or modified sequence from SFTSV(HB29)__NC_018137.1__N (opt1)
gggagaaagcuuaccaugagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcggggcgccuccaagacggagguguacaacagcuuccgcgacccccuccacgcggccgucaacuccguguucuucccgaacgacgugcgggucaaguggcugaaggccaaggggauccugggccccgacggcgugcccagccgcgccgccgagguggcggccgccgccuaccggaaccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17460 - RNA, 3439 nt, Artificial Sequence
  mRNA product Design1 comprising derived and/or modified sequence from SFTSV(HB29)__NC_018138.1__GP (opt1)
gggagaaagcuuaccaugaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcacccggguccgcccgaagugcuacggguucagccggaugauggcgacccuggaggugaacccgcccgagcagcgcaucggccagugcacggggugccaccucgagugcaucaacggcggggugcggcugaucacccugaccuccgagcuccgcagcgccaccgucugcgccucccacuucugcagcuccgccagcuccggcaagaaguccacggagauccacuuccacuccggcagccugguggggaagaccgccauccacgucaagggcgcgcugguggacgggaccgaguucaccuucgagggcuccugcauguuccccgacggcugcgacgccguggacugcacguucugccgggaguuccucaagaacccccagugcuaccccgccaagaaguggcuguucaucaucaucgucauccugcucggguacgccggccugaugcugcucaccaacgugcugaaggccaucgggguguggggcagcugggucaucgcgcccgugaagcugauguucgccaucaucaagaagcucaugcgcaccguguccugccuggucgggaagcugauggaccggggccgccaggugauccacgaggagaucggcgagaacggggagggcaaccaggacgacgugcggaucgagauggcccgcccccgccggguccgccacuggauguacagcccggugauccucaccauccuggccaucgggcuggccgagggcugcgacgagauggugcacgcggacuccaagcucgucagcugccggcagggguccggcaacaugaaggagugcaucacgaccggccgcgcccugcugcccgccgugaaccccgggcaggaggccugccuccacuucaccgcccccggcagcccggacagcaagugccugaagaucaaggugaagcggaucaaccugaagugcaagaaguccagcuccuacuucguccccgacgcgcgcagccggugcaccuccgugcgccggugccgcugggccggggacugccagagcggcugcccgccccacuucacguccaacagcuucuccgacgacugggccgggaagauggaccgggccggccucggcuucagcgggugcuccgacggcugcgggggcgcggccugcgggugcuucaacgccgcccccagcugcaucuucuggcgcaaguggguggagaacccccacggcaucaucuggaaggucucccccugcgccgcgugggugccgagcgccgugaucgagcugaccaugcccuccggcgagguccggaccuuccaccccaugagcgggauccccacccagguguucaagggcguguccgucacguaccuggggagcgacauggagguguccggccucaccgaccugugcgagaucgaggagcucaagagcaagaagcuggcccuggccccgugcaaccaggccggcauggggguggucggcaaggugggggagauccagugcagcuccgaggagagcgcgcgcaccaucaagaaggacggcugcaucuggaacgccgaccugguggggaucgagcugcgggucgacgacgccgugugcuacuccaagaucaccagcguggaggccgucgccaacuacuccgcgauccccacgaccaucggcggccuccgcuucgagcggagccacgacucccaggggaagaucagcggcagcccccuggacaucaccgccauccgcgggagcuucuccgugaacuaccggggccugcgccucagccuguccgagaucaccgccacgugcaccggggaggugaccaacgucagcggcugcuacuccugcaugaccggcgccaaggugagcaucaagcugcacuccagcaagaacuccaccgcgcacgugcgcugcaagggggacgagacggccuucagcguccucgagggcgugcacagcuacaucgugcggcuguccuucgaccacgccgucguggacgagcagugccagcugaacugcgggggccacgagagccaggugacccucaaggggaaccugaucuuccuggacguccccaaguucguggacggcuccuacaugcagaccuaccacagcaccgugccgacgggcgccaacauccccucccccaccgacuggcucaacgcccuguucgggaacggccugagccgcuggauccucggggucaucggcgugcugcugggcgggcucgcgcuguucuuccugaucauguuccuccugaagcugggcaccaagcaggucuuccggucccgcaccaagcucgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17461 - RNA, 3436 nt, Artificial Sequence
  mRNA product Design1 comprising derived and/or modified sequence from SFTSV(HB29)__NC_018138.1__IgE-leader_Gn-Gc (opt1)
gggagaaagcuuaccauggacuggaccuggauccuguuccucguggccgccgcgacccgcguccacagcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcacccggguccgcccgaagugcuacggguucagccggaugauggcgacccuggaggugaacccgcccgagcagcgcaucggccagugcacggggugccaccucgagugcaucaacggcggggugcggcugaucacccugaccuccgagcuccgcagcgccaccgucugcgccucccacuucugcagcuccgccagcuccggcaagaaguccacggagauccacuuccacuccggcagccugguggggaagaccgccauccacgucaagggcgcgcugguggacgggaccgaguucaccuucgagggcuccugcauguuccccgacggcugcgacgccguggacugcacguucugccgggaguuccucaagaacccccagugcuaccccgccaagaaguggcuguucaucaucaucgucauccugcucggguacgccggccugaugcugcucaccaacgugcugaaggccaucgggguguggggcagcugggucaucgcgcccgugaagcugauguucgccaucaucaagaagcucaugcgcaccguguccugccuggucgggaagcugauggaccggggccgccaggugauccacgaggagaucggcgagaacggggagggcaaccaggacgacgugcggaucgagauggcccgcccccgccggguccgccacuggauguacagcccggugauccucaccauccuggccaucgggcuggccgagggcugcgacgagauggugcacgcggacuccaagcucgucagcugccggcagggguccggcaacaugaaggagugcaucacgaccggccgcgcccugcugcccgccgugaaccccgggcaggaggccugccuccacuucaccgcccccggcagcccggacagcaagugccugaagaucaaggugaagcggaucaaccugaagugcaagaaguccagcuccuacuucguccccgacgcgcgcagccggugcaccuccgugcgccggugccgcugggccggggacugccagagcggcugcccgccccacuucacguccaacagcuucuccgacgacugggccgggaagauggaccgggccggccucggcuucagcgggugcuccgacggcugcgggggcgcggccugcgggugcuucaacgccgcccccagcugcaucuucuggcgcaaguggguggagaacccccacggcaucaucuggaaggucucccccugcgccgcgugggugccgagcgccgugaucgagcugaccaugcccuccggcgagguccggaccuuccaccccaugagcgggauccccacccagguguucaagggcguguccgucacguaccuggggagcgacauggagguguccggccucaccgaccugugcgagaucgaggagcucaagagcaagaagcuggcccuggccccgugcaaccaggccggcauggggguggucggcaaggugggggagauccagugcagcuccgaggagagcgcgcgcaccaucaagaaggacggcugcaucuggaacgccgaccugguggggaucgagcugcgggucgacgacgccgugugcuacuccaagaucaccagcguggaggccgucgccaacuacuccgcgauccccacgaccaucggcggccuccgcuucgagcggagccacgacucccaggggaagaucagcggcagcccccuggacaucaccgccauccgcgggagcuucuccgugaacuaccggggccugcgccucagccuguccgagaucaccgccacgugcaccggggaggugaccaacgucagcggcugcuacuccugcaugaccggcgccaaggugagcaucaagcugcacuccagcaagaacuccaccgcgcacgugcgcugcaagggggacgagacggccuucagcguccucgagggcgugcacagcuacaucgugcggcuguccuucgaccacgccgucguggacgagcagugccagcugaacugcgggggccacgagagccaggugacccucaaggggaaccugaucuuccuggacguccccaaguucguggacggcuccuacaugcagaccuaccacagcaccgugccgacgggcgccaacauccccucccccaccgacuggcucaacgcccuguucgggaacggccugagccgcuggauccucggggucaucggcgugcugcugggcgggcucgcgcuguucuuccugaucauguuccuccugaagcugggcaccaagcaggucuuccggucccgcaccaagcucgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17462 - RNA, 955 nt, Artificial Sequence
  mRNA product Design1 comprising derived and/or modified sequence from SFTSV(HB29)__NC_018137.1__N (opt5)
gggagaaagcuuaccaugagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugagcgaggcgaccacgaaaacccugauggaagccuacucccuuuggcaggaugcuuuuacaaagaccauuaauguuaagaugcgcggggccagcaaaacagagguguauaacucuuuccgggacccucugcacgcugccgucaauuccguguuuuucccgaacgaugugagagucaaguggcucaaagccaagggaauccugggccccgacgggguuccuagccgggcugcggaaguggccgcugccgccuaccgcaaucugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17463 - RNA, 3439 nt, Artificial Sequence
  mRNA product Design1 comprising derived and/or modified sequence from SFTSV(HB29)__NC_018138.1__GP (opt5)
gggagaaagcuuaccaugaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaggcuucugaagccaaaugucggugcucccuggugcauaagccuggggaaguggucgugagcuacggaggcacacgcguuagacccaaauguuacggguucucccggaugauggcgacccuugaggugaacccucccgaacagcgcaucggacaaugcacgggcugucaccuggagugcauuaaugggggcgucagacucaucacccugacaucugagcugcggagcgccaccgugugugcuucccauuuuugcucuagcgccuccagcggaaagaagucuacagaaauucacuuccacuccggcagccucguugggaaaaccgcuauccaugugaagggagcccuggucgacggcacggaguucacauuugaagggucuuguauguuccccgauggaugcgacgcgguggauugcaccuuuugucgcgaguuccuuaaaaacccucagugcuauccggccaagaaauggcuguuuaucauuaucgucauucuccugggcuacgcugggcuuaugcugcucacaaaugugcugaaggccaucggcguuuggggauccugggugauugcucccgucaagcugauguucgccaucaucaaaaagcucaugagaaccgugagcugucugguuggcaaacuuauggaccgggggagacaggugauucacgaagagaucggagagaacggcgaagggaaucaagaugacguccgcauugagauggcccggccuagacgcgugcggcauuggauguauucucccgugauccugaccauucucgcuaucggacuggcggaaggcugcgaugagaugguucacgccgacagcaagcuggucuccuguagacaggggagcggcaacaugaaagagugcauuacaacgggacgcgcucugcucccugccgugaaucccggccaggaagccugucugcauuuuaccgcuccggggucuccugauuccaagugccugaagaucaaagugaagcggaucaaccucaaauguaagaaaagcuccucuuacuucguccccgacgccagaagccgcugcacauccgugcggagaugucgcugggcgggagauugccagucuggcugcccuccccacuuuaccagcaauuccuucucugacgacugggcugggaagauggaucgggccggacugggcuuuagcggguguuccgacggcugcggaggcgccgcuugugggugcuucaacgccgcuccuagcuguaucuuuuggagaaaguggguugagaauccccacggaauuauuuggaaagugucuccgugcgccgcgugggucccuuccgccgugaucgaacuuacaaugcccagcggcgagguucggaccuuccaucccaugucugggauuccuacgcaaguguucaagggagucuccgugacauaucugggcagcgauauggaaguuucuggccucaccgaccugugugagaucgaggaacugaaauccaagaaacuugcucucgccccgugcaaccaggcugggaugggaguggucggcaaggugggggagauccaguguagcuccgaagagagcgcccgcaccauuaaaaaggauggaugcaucuggaacgcggaccuggugggcauugaacugagagucgaugacgccguuuguuacucuaagaucacaagcguggaggcuguggccaauuauuccgcuauucccaccacaaucgggggacuccgguuugagagaucucacgauagccagggcaaaaucuccggcucuccucuggacauuacggccauccgcgggagcuucuccgucaacuaccggggacuuagacugucucucagcgaaauuaccgccacaugcaccggcgaggugacaaauguuuccgggugcuacagcuguaugaccggagcuaaggugucuaucaaacugcauuccagcaagaacucuacggcgcacguccgcugcaaaggcgaugaaaccgccuuuuccgugcuggaggggguucacagcuauauugugagacuuuccuucgaccaugcugucguggaugaacaaugucagcucaauugcggaggccacgagucucagguuacacugaagggcaaccugaucuuucucgacgugcccaaguucgucgacgggagcuacaugcagaccuaucauuccacagugccuaccggagccaauauccccagcccuacggauuggcugaacgcccuuuuuggcaaugggcugucucgguggauucucggagugaucggcguccugcuugggggacuugcucucuucuuucugauuauguuccugcucaaacugggcacaaagcaaguuuuucgcuccagaaccaaacuugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17464 - RNA, 3436 nt, Artificial Sequence
  mRNA product Design1 comprising derived and/or modified sequence from SFTSV(HB29)__NC_018138.1__IgE-leader_Gn-Gc (opt5)
gggagaaagcuuaccauggacuggaccuggauccuguuccucguggccgcugccacaagaguccacagcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaggcuucugaagccaaaugucggugcucccuggugcauaagccuggggaaguggucgugagcuacggaggcacacgcguuagacccaaauguuacggguucucccggaugauggcgacccuugaggugaacccucccgaacagcgcaucggacaaugcacgggcugucaccuggagugcauuaaugggggcgucagacucaucacccugacaucugagcugcggagcgccaccgugugugcuucccauuuuugcucuagcgccuccagcggaaagaagucuacagaaauucacuuccacuccggcagccucguugggaaaaccgcuauccaugugaagggagcccuggucgacggcacggaguucacauuugaagggucuuguauguuccccgauggaugcgacgcgguggauugcaccuuuugucgcgaguuccuuaaaaacccucagugcuauccggccaagaaauggcuguuuaucauuaucgucauucuccugggcuacgcugggcuuaugcugcucacaaaugugcugaaggccaucggcguuuggggauccugggugauugcucccgucaagcugauguucgccaucaucaaaaagcucaugagaaccgugagcugucugguuggcaaacuuauggaccgggggagacaggugauucacgaagagaucggagagaacggcgaagggaaucaagaugacguccgcauugagauggcccggccuagacgcgugcggcauuggauguauucucccgugauccugaccauucucgcuaucggacuggcggaaggcugcgaugagaugguucacgccgacagcaagcuggucuccuguagacaggggagcggcaacaugaaagagugcauuacaacgggacgcgcucugcucccugccgugaaucccggccaggaagccugucugcauuuuaccgcuccggggucuccugauuccaagugccugaagaucaaagugaagcggaucaaccucaaauguaagaaaagcuccucuuacuucguccccgacgccagaagccgcugcacauccgugcggagaugucgcugggcgggagauugccagucuggcugcccuccccacuuuaccagcaauuccuucucugacgacugggcugggaagauggaucgggccggacugggcuuuagcggguguuccgacggcugcggaggcgccgcuugugggugcuucaacgccgcuccuagcuguaucuuuuggagaaaguggguugagaauccccacggaauuauuuggaaagugucuccgugcgccgcgugggucccuuccgccgugaucgaacuuacaaugcccagcggcgagguucggaccuuccaucccaugucugggauuccuacgcaaguguucaagggagucuccgugacauaucugggcagcgauauggaaguuucuggccucaccgaccugugugagaucgaggaacugaaauccaagaaacuugcucucgccccgugcaaccaggcugggaugggaguggucggcaaggugggggagauccaguguagcuccgaagagagcgcccgcaccauuaaaaaggauggaugcaucuggaacgcggaccuggugggcauugaacugagagucgaugacgccguuuguuacucuaagaucacaagcguggaggcuguggccaauuauuccgcuauucccaccacaaucgggggacuccgguuugagagaucucacgauagccagggcaaaaucuccggcucuccucuggacauuacggccauccgcgggagcuucuccgucaacuaccggggacuuagacugucucucagcgaaauuaccgccacaugcaccggcgaggugacaaauguuuccgggugcuacagcuguaugaccggagcuaaggugucuaucaaacugcauuccagcaagaacucuacggcgcacguccgcugcaaaggcgaugaaaccgccuuuuccgugcuggaggggguucacagcuauauugugagacuuuccuucgaccaugcugucguggaugaacaaugucagcucaauugcggaggccacgagucucagguuacacugaagggcaaccugaucuuucucgacgugcccaaguucgucgacgggagcuacaugcagaccuaucauuccacagugccuaccggagccaauauccccagcccuacggauuggcugaacgcccuuuuuggcaaugggcugucucgguggauucucggagugaucggcguccugcuugggggacuugcucucuucuuucugauuauguuccugcucaaacugggcacaaagcaaguuuuucgcuccagaaccaaacuugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17465 - RNA, 955 nt, Artificial Sequence
  mRNA product Design1 comprising derived and/or modified sequence from SFTSV(HB29)__NC_018137.1__N (opt11)
gggagaaagcuuaccaugagcgaguggucgcgcauagccguggaguucggcgaacaacaacucaaccuaacagaauuggaagacuucgcacgcgagcuagcguacgagggccuggacccggcccuaaucaucaaaaagcuaaaggaaacgggaggggacgacuggguaaaagacaccaaauucauaauaguguucgcgcuaacgcgcgggaacaagaucgugaaagcgagcggaaaaaugagcaacagcgggagcaagcgccugauggcgcuucaggaaaaguacgggcucguggaacgggccgagaccaggcucucgauaacgcccgugcgcguggcacagagccugcccacguggacaugcgcagccgcagccgcacuaaaagaauaccucccgguagggccagcggucaugaacuugaaaguagaaaacuacccgcccgagaugaugugcauggccuucggcucgcuaauaccaacggccggggucucggaagcgaccacgaaaacacucauggaagcguacucacucuggcaagacgccuucaccaaaaccauaaacguaaaaaugcgaggggccucgaaaacggaaguguacaacagcuuucgcgacccccugcacgcggccgugaacucggucuucuucccgaacgauguaagggucaaguggcugaaagcaaaagggauccugggcccggacggggucccgagcagggccgcggaaguggccgcagccgcguacaggaaccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17466 - RNA, 3439 nt, Artificial Sequence
  mRNA product Design1 comprising derived and/or modified sequence from SFTSV(HB29)__NC_018138.1__GP (opt11)
gggagaaagcuuaccaugaugaaaguaauaugguucucuucccucauaugccuagucauccagugcagcggcgacuccgggcccaucauaugcgcaggccccauccacagcaacaaaucagcagggauaccccaccuccucggauacucagagaaaauaugccaaauagacagauuaauccacgugagcuccuggcugcggaaccacucucaauuccaaggguacgucggucaacgagggggaagaagccaagucucauacuacccagcagaaaacagcuacuccagauggagcggauuacuaucgccuugcgacgcagacuggcuaggcaugcuaguaguaaagaaagccaaagaauccgacaugaucgugccaggccccucuuacaaaggaaaaguauuuuucgaaaggccaacauucgacggauacgucggcuggggcugcggcuccggaaaaagcaggacugagagcggggagcuauguucaucagacagcggcacgucgagcggccuccucccaucagaccggguccuguggaucggagacgucgccugccaacccaugaccccgauaccagaagagacauuccuagagcuaaagagcuucucccaaagcgaguuccccgacauaugcaaaauagacggcauagucuucaaucaaugcgagggagaaucccucccucagccuuucgaugucgcauggauggacguggggcacucacauaaaauuaucaugcgagaacacaaaacgaaauggguccaggaauccagcagcaaagauuucguaugcuauaaagaaggaacaggacccugcucagaaucagaggaaaaagccugcaaaaccucaggcucgugcagaggugacaugcaguucuguaaagucgccggaugcgaacacggggaagaagcaagcgaggccaaaugccgcugcagccuuguccacaagccaggagaaguagucgucuccuacggcggcaccaggguccgccccaaaugcuacggcuucuccagaaugauggccacccucgaagucaacccgcccgaacaacgcaucggacaaugcacaggcugccaccucgaaugcauaaacggcggagugagacugaucacccuaaccuccgagcuccggagcgccaccgugugugcaucccacuucugcagcuccgccucaagcggcaaaaagaguaccgaaauccacuuccacucgggaagccugguaggaaaaacagccauccaugugaaaggagcccucguagacggaacagaguucacauucgaaggaagcugcauguucccugacggcugcgacgccguagacugcaccuuuugccgagaguuccucaaaaacccccaaugcuaucccgccaagaaauggcuuuuuaucauaauuguaaucuugcucggcuacgccggccuaaugcuacucaccaacgugcucaaagccauaggaguaugggggucaugggucaucgccccagugaaacuaauguucgcaauaaucaaaaagcuaaugcgaacgguaucaugccuagucggaaaacuaauggacagaggacgccaaguaauacacgaagaaaucggggagaacggggaggguaaccaggacgacguccgaauagagauggcgaggccccggagagugcgccacuggauguacagcccaguaauacuaaccauucuagccauaggacuggcugaaggaugugaugaaaugguacaugccgauagcaaacugguauccugccggcaaggauccggaaacaugaaggaaugcaucacaacagggagagcccugcuaccggcaguaaacccuggacaagaagcaugccugcacuuuaccgcgccggggagccccgacagcaaaugccucaagauaaaggucaagcgaauaaaccuaaaaugcaagaaaucuagcaguuacuucguaccagacgcaagaagcagaugcaccucaguucgacggugccgcugggccggugacugccaguccggcuguccgccccauuucacgagcaacagcuucagugacgacugggcaggcaaaauggacagagcuggacucggcuucagcggcugcagcgacggcugugggggagcggccugcgggugcuuuaacgcagcaccuagcugcaucuucuggcgaaagugggucgaaaacccacacgggauaauauggaaggucagccccugcgcagcauggguaccauccgccgucauagaauuaacaaugccguccggcgaaguucgcacauuccaucccaugucaggcauaccaacccaggucuuuaaaggcgucucaguaaccuaccuaggaucagacauggagguaagcggacuuacagaccucugugaaauagaggaacucaagagcaagaaacucgcacucgcgccuugcaaccaggcaggcaugggcguagucggcaaaguuggggaaauccagugcucaagcgaagaaagcgcccgcaccaucaagaaagacggaugcaucuggaacgcggaucuagucggaaucgagcuacgcguugaugacgccguaugcuacagcaaaaucaccucaguagaggccgucgcaaacuacuccgccauacccacaacuauaggcggucucagguucgagcgcucccacgacucccagggaaaaauaucaggcucgccccuagacauaaccgccauccgaggcucauucucagucaacuaccgcggccuucgccucagccucuccgaaauuacggcaaccugcaccggagaaguaacgaacgucucagguugcuauucgugcaugaccggagccaaagucagcauaaaacugcacuccagcaaaaacucaacagcgcacguacgaugcaaaggcgacgaaacagcauucucaguacuugaaggaguccacuccuacaucguuaggcuauccuuugaccaugccgucgucgacgaacaaugucaacuaaacugcgggggacacgaaucgcaagugacucuaaaaggaaaccugauauuucucgacgucccgaaauucguagacgggucuuauaugcagacauaccacagcacgguaccaacuggagccaacauaccaucacccacagacuggcugaacgcucuauucggaaacggccucucaagguggauacuaggggucauaggcguucuccuaggaggccucgcacuauucuuccuaaucauguuucugcucaaacucggcacaaagcaaguauucagaagccgaacuaaacuagcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17467 - RNA, 3436 nt, Artificial Sequence
  mRNA product Design1 comprising derived and/or modified sequence from SFTSV(HB29)__NC_018138.1__IgE-leader_Gn-Gc (opt11)
gggagaaagcuuaccauggauuggacguggauacucuuucucguggccgcggccacgcgcgugcacucggacuccgggcccaucauaugcgcaggccccauccacagcaacaaaucagcagggauaccccaccuccucggauacucagagaaaauaugccaaauagacagauuaauccacgugagcuccuggcugcggaaccacucucaauuccaaggguacgucggucaacgagggggaagaagccaagucucauacuacccagcagaaaacagcuacuccagauggagcggauuacuaucgccuugcgacgcagacuggcuaggcaugcuaguaguaaagaaagccaaagaauccgacaugaucgugccaggccccucuuacaaaggaaaaguauuuuucgaaaggccaacauucgacggauacgucggcuggggcugcggcuccggaaaaagcaggacugagagcggggagcuauguucaucagacagcggcacgucgagcggccuccucccaucagaccggguccuguggaucggagacgucgccugccaacccaugaccccgauaccagaagagacauuccuagagcuaaagagcuucucccaaagcgaguuccccgacauaugcaaaauagacggcauagucuucaaucaaugcgagggagaaucccucccucagccuuucgaugucgcauggauggacguggggcacucacauaaaauuaucaugcgagaacacaaaacgaaauggguccaggaauccagcagcaaagauuucguaugcuauaaagaaggaacaggacccugcucagaaucagaggaaaaagccugcaaaaccucaggcucgugcagaggugacaugcaguucuguaaagucgccggaugcgaacacggggaagaagcaagcgaggccaaaugccgcugcagccuuguccacaagccaggagaaguagucgucuccuacggcggcaccaggguccgccccaaaugcuacggcuucuccagaaugauggccacccucgaagucaacccgcccgaacaacgcaucggacaaugcacaggcugccaccucgaaugcauaaacggcggagugagacugaucacccuaaccuccgagcuccggagcgccaccgugugugcaucccacuucugcagcuccgccucaagcggcaaaaagaguaccgaaauccacuuccacucgggaagccugguaggaaaaacagccauccaugugaaaggagcccucguagacggaacagaguucacauucgaaggaagcugcauguucccugacggcugcgacgccguagacugcaccuuuugccgagaguuccucaaaaacccccaaugcuaucccgccaagaaauggcuuuuuaucauaauuguaaucuugcucggcuacgccggccuaaugcuacucaccaacgugcucaaagccauaggaguaugggggucaugggucaucgccccagugaaacuaauguucgcaauaaucaaaaagcuaaugcgaacgguaucaugccuagucggaaaacuaauggacagaggacgccaaguaauacacgaagaaaucggggagaacggggaggguaaccaggacgacguccgaauagagauggcgaggccccggagagugcgccacuggauguacagcccaguaauacuaaccauucuagccauaggacuggcugaaggaugugaugaaaugguacaugccgauagcaaacugguauccugccggcaaggauccggaaacaugaaggaaugcaucacaacagggagagcccugcuaccggcaguaaacccuggacaagaagcaugccugcacuuuaccgcgccggggagccccgacagcaaaugccucaagauaaaggucaagcgaauaaaccuaaaaugcaagaaaucuagcaguuacuucguaccagacgcaagaagcagaugcaccucaguucgacggugccgcugggccggugacugccaguccggcuguccgccccauuucacgagcaacagcuucagugacgacugggcaggcaaaauggacagagcuggacucggcuucagcggcugcagcgacggcugugggggagcggccugcgggugcuuuaacgcagcaccuagcugcaucuucuggcgaaagugggucgaaaacccacacgggauaauauggaaggucagccccugcgcagcauggguaccauccgccgucauagaauuaacaaugccguccggcgaaguucgcacauuccaucccaugucaggcauaccaacccaggucuuuaaaggcgucucaguaaccuaccuaggaucagacauggagguaagcggacuuacagaccucugugaaauagaggaacucaagagcaagaaacucgcacucgcgccuugcaaccaggcaggcaugggcguagucggcaaaguuggggaaauccagugcucaagcgaagaaagcgcccgcaccaucaagaaagacggaugcaucuggaacgcggaucuagucggaaucgagcuacgcguugaugacgccguaugcuacagcaaaaucaccucaguagaggccgucgcaaacuacuccgccauacccacaacuauaggcggucucagguucgagcgcucccacgacucccagggaaaaauaucaggcucgccccuagacauaaccgccauccgaggcucauucucagucaacuaccgcggccuucgccucagccucuccgaaauuacggcaaccugcaccggagaaguaacgaacgucucagguugcuauucgugcaugaccggagccaaagucagcauaaaacugcacuccagcaaaaacucaacagcgcacguacgaugcaaaggcgacgaaacagcauucucaguacuugaaggaguccacuccuacaucguuaggcuauccuuugaccaugccgucgucgacgaacaaugucaacuaaacugcgggggacacgaaucgcaagugacucuaaaaggaaaccugauauuucucgacgucccgaaauucguagacgggucuuauaugcagacauaccacagcacgguaccaacuggagccaacauaccaucacccacagacuggcugaacgcucuauucggaaacggccucucaagguggauacuaggggucauaggcguucuccuaggaggccucgcacuauucuuccuaaucauguuucugcucaaacucggcacaaagcaaguauucagaagccgaacuaaacuagcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17468 - RNA, 1120 nt, Artificial Sequence
  mRNA product Design2 comprising derived and/or modified sequence from SFTSV(HB29)__NC_018137.1__N (wt)
ggggcgcugccuacggagguggcagccaucuccuucucggcaucaagcuuaccaugucggagugguccaggauugcaguggaguuuggugagcagcagcucaauuugacugagcuugaggacuucgcgagagagcuggccuaugaaggccuugacccugcuuugaucaucaagaagcugaaggagacagguggagaugauugggugaaggauacaaaguucaucauugucuuugcccugacucgaggcaauaagaucgucaaggcaucagggaaaaugucaaacucaggguccaagagguugauggcacuccaagagaaauauggacugguugagagggcagagaccaggcucucaaucacuccagugaggguugcgcagagccuucccacuuggacaugugcugcugcagcagcucuaaaggaguaucucccaguagggccagccgucaugaaccugaagguugagaauuaucccccugagaugaugugcauggccuuuggaucccugauuccaacugcggggguaucugaagccacaaccaagacccugauggaggccuacucucuguggcaagaugccuucaccaagacuaucaauguaaagaugcgcggagccagcaagacagaaguuuacaacuccuucagggacccucuucaugcugcugugaacucugucuucuuucccaaugauguucggguaaaguggcugaaggccaaggggauccuuggcccagaugggguccccagcagagcugcugagguugcugcugcugcuuacagaaaccuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17469 - RNA, 3604 nt, Artificial Sequence
  mRNA product Design2 comprising derived and/or modified sequence from SFTSV(HB29)__NC_018138.1__GP (wt)
ggggcgcugccuacggagguggcagccaucuccuucucggcaucaagcuuaccaugaugaaagucaucugguucuccucucugaucugcuuagucauucaaugcaguggggauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggacgcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcagagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagugggugcuauuccugcaugacaggugccaaagucuccaucaaauugcauagcagcaaaaauagcacugcccauguuagaugcaaaggggaugagacugcauucagugucuuggagggaguccauagcuacauuguccgccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17470 - RNA, 3604 nt, Artificial Sequence
  mRNA product Design2 comprising derived and/or modified sequence from SFTSV(HB29)__NC_018138.1__GP (wt)
ggggcgcugccuacggagguggcagccaucuccuucucggcaucaagcuuaccaugaugaaagucaucugguucuccucucugaucugcuuagucauucaaugcaguggggauucgggcccaaucaucugcgcaggacccauccacucaaacaagagugcuggcauaccccaccuccuugguuacucugagaagauuugucagauagaucggcugauacauguuucgucauggcucaggaaccacucgcaauuucaaggcuacguugggcagcgagguggacgcucucagguuagcuacuacccagcugagaacucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaguucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggacgcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaguucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcagagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagaacucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacaaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagugggugcuauuccugcaugacaggugccaaagucuccaucaaauugcauagcagcaaaaauagcacugcccauguuagaugcaaaggggaugagacugcauucagugucuuggagggaguccauagcuacauuguccgccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17471 - RNA, 3601 nt, Artificial Sequence
  mRNA product Design2 comprising derived and/or modified sequence from SFTSV(HB29)__NC_018138.1__IgE-leader_Gn-Gc (wt)
ggggcgcugccuacggagguggcagccaucuccuucucggcaucaagcuuaccauggacuggaccuggauccuguuccucguggccgccgcgacccgcguccacagcgauucgggcccaaucaucugcgcaggacccauccacucaaacaagagugcuggcauaccccaccugcuugguuacucugagaagauuugucagauagaucggcugauacauguuucgucauggcucaggaaccacucgcaauuucaaggcuacguugggcagcgagguggacgcucucagguuagcuacuacccagcugagaauucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaauucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggacgcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaauucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcagagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagagcucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacuaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagugggugcuauuccugcaugacaggugccaaagucuccaucaaauugcauagcagcaaaaauagcacugcccauguuagaugcaaaggggaugagacugcauucagugucuuggagggaguccauagcuacauuguccgccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17472 - RNA, 3601 nt, Artificial Sequence
  mRNA product Design2 comprising derived and/or modified sequence from SFTSV(HB29)__NC_018138.1__IgE-leader_Gn-Gc (wt)
ggggcgcugccuacggagguggcagccaucuccuucucggcaucaagcuuaccauggacuggaccuggauccuguuccucguggccgccgcgacccgcguccacagcgauucgggcccaaucaucugcgcaggacccauccacucaaacaagagugcuggcauaccccaccuccuugguuacucugagaagauuugucagauagaucggcugauacauguuucgucauggcucaggaaccacucgcaauuucaaggcuacguugggcagcgagguggacgcucucagguuagcuacuacccagcugagaacucuuacucgagguggaguggacuucuaagccccugugaugcugauuggcuugggaugcuugucgugaagaaggcuaaggagucugauaugauaguuccugggccuucauacaaggggaaagucuuuuuugaacggccaacuuuugauggauacguaggcuggggcuguggcagugggaagucuaggacugagucaggagagcucugcaguucagacucagggacaaguucuggucuucugcccucggauaggguucucuggauaggugauguugcuugucagccuaugacacccaucccugaggagacauuucuggagcugaagaguuuuagccaaagugaguucccagacauauguaaaauugauggcauuguguucaaccagugugagggugagagucuaccccagcccuuugauguugcauggauggauguuggccacucucauaagaucaucaugagggagcacaagaccaaauggguacaagagagcucauccaaggauuuugugugcuacaaggaagggacuggaccuuguucugaaucagaagaaaaggcuuguaagaccaguggaucaugcagaggggacaugcaguuuugcaagguggcagguugcgaacauggagaggaggcaucugaggccaaguguagaugcucacuugugcacaagccuggggaagucguugugucauauggagggacgcgugucagaccaaagugcuacgguuucuccagaaugauggcaacacuggaggugaacccaccagagcaaaggauuggucaaugcacuggcugccaucuagaaugcauaaaugggggugugaggcuaaucacucuaaccagugagcucaggucagcuacugucugugcuucccacuuuugcaguucugccucaagugguaagaaaagcacggagauucauuuccacucaggaucauugguugggaaaacagcuauccaugucaaaggggcauugguagauggaacugaguucacauuugaggguaguugcauguucccagauggaugugaugcaguggacugcacauucugucgugaguuucuaaaaaauccucagugcuacccugcaaagaaguggcuguucaucauuauugucauccuccuuggauaugcaggccucauguuacucaccaauguccuuaaggcaauuggggucuggggaucauggguaauagcuccagugaagcuaauguuugccaucauaaagaaacuaaugagaacugugagcugcuugguggggaaauugauggauaggggaaggcaagugauccaugaggaaauaggggagaauggggagggcaaccaagaugauguuaggauugagauggcaagacccagaaggguaaggcauuggauguacucaccugucauccugaccauucuagcaauagggcuugcagagggcugugaugagaugguccaugcugauucuaaacuuguuucaugcagacaagggagcggaaacaugaaggaaugcauaacaacugggagggcgcuucuuccugcggugaacccaggacaagaggcaugucugcacuucacagcaccugggaguccggacucaaaaugucucaaaauuaagguuaagaggaucaaccuaaaauguaagaagucaucaucauauuuuguuccugaugcccgguccagguguacaucagugaggagaugucguugggcgggagacugccagucugggugccccccucauuucacauccaacuccuuuucugaugauugggcagguaagauggacagggcuggucuuggauucaguggcugcucugauggauguggaggagcagccugcggcugcuuuaaugcggccccuucaugcaucuucuggaggaaauggguggagaauccacaugggaucaucuggaaagugucuccaugcgccgcaugggucccaucagcaguuauagagcuaacaaugcccucaggugaggugaggacauuccaccccaugagcggcauccccacacaggucuucaagggugugaguguaacuuacuugggcucagauauggaggugucuggcuugacugaccugugugagauagaagaacucaaguccaaaaagcuggcauuagcucccugcaaccaggcuggcauggggguuguaggcaagguuggagagauacagugcaguagcgaggagagugcccguaccauaaaaaaagaugggugcauauggaacgcagaccucguggguauagagcuacgaguggaugacgcugugugcuacucuaagauuacaaguguggaggcaguugcaaacuacucugccauacccaccacuauuggggggcugagguuugagagaagccaugacagccaggguaaaauaucugguagcccccuggacaucacagcuauaagaggauccuuuucuguuaauuauagaggccuucgauuaagucucucagaaauuacugcuacuugcacaggggaggugacaaaugugagugggugcuauuccugcaugacaggugccaaagucuccaucaaauugcauagcagcaaaaauagcacugcccauguuagaugcaaaggggaugagacugcauucagugucuuggagggaguccauagcuacauuguccgccucagcuuugaccaugcaguagucgaugagcaaugccagcugaacugugggggacaugagagucaagugacucuuaaaggcaaccucaucuuccuggaugucccaaaauuuguggauggcagcuacaugcagacauaucacaguacugugccaacaggggcaaauaucccaagcccuacagauuggcugaaugccuuguuuggcaaugggcugaguagguggauccugggggugauagggguucuacuggggggauuggcucucuuuuucuugaucauguuuuugcucaagcugggaacaaaacagguauuucgaucgaggacgaagcuggcuuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17473 - RNA, 1120 nt, Artificial Sequence
  mRNA product Design2 comprising derived and/or modified sequence from SFTSV(HB29)__NC_018137.1__N (opt4)
ggggcgcugccuacggagguggcagccaucuccuucucggcaucaagcuuaccaugagcgaguggagcagaaucgccguggaguucggcgagcagcagcugaaccugaccgagcuggaggacuucgccagagagcuggccuacgagggccuggaccccgcccugaucaucaagaagcugaaggagaccggcggcgacgacugggugaaggacaccaaguucaucaucguguucgcccugaccagaggcaacaagaucgugaaggccagcggcaagaugagcaacagcggcagcaagagacugauggcccugcaggagaaguacggccugguggagagagccgagaccagacugagcaucacccccgugagaguggcccagagccugcccaccuggaccugcgccgccgccgccgcccugaaggaguaccugcccgugggccccgccgugaugaaccugaagguggagaacuacccccccgagaugaugugcauggccuucggcagccugauccccaccgccggcgugagcgaggccaccaccaagacccugauggaggccuacagccuguggcaggacgccuucaccaagaccaucaacgugaagaugagaggcgccagcaagaccgagguguacaacagcuucagagacccccugcacgccgccgugaacagcguguucuuccccaacgacgugagagugaaguggcugaaggccaagggcauccugggccccgacggcgugcccagcagagccgccgagguggccgccgccgccuacagaaaccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17474 - RNA, 3604 nt, Artificial Sequence
  mRNA product Design2 comprising derived and/or modified sequence from SFTSV(HB29)__NC_018138.1__GP (opt4)
ggggcgcugccuacggagguggcagccaucuccuucucggcaucaagcuuaccaugaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaccagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccagcagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagacugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17475 - RNA, 3601 nt, Artificial Sequence
  mRNA product Design2 comprising derived and/or modified sequence from SFTSV(HB29)__NC_018138.1__IgE-leader_Gn-Gc (opt4)
ggggcgcugccuacggagguggcagccaucuccuucucggcaucaagcuuaccauggacuggaccuggauccuguuccugguggccgccgccaccagagugcacagcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaccagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccagcagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagacugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17476 - RNA, 1120 nt, Artificial Sequence
  mRNA product Design2 comprising derived and/or modified sequence from SFTSV(HB29)__NC_018137.1__N (opt3)
ggggcgcugccuacggagguggcagccaucuccuucucggcaucaagcuuaccaugagcgagugguccagaaucgccguggaguucggcgaacagcaacugaaccucaccgaacuugaggacuuugcuagggaacuggcauacgagggguuggaucccgccuuaauuauaaagaaacugaaggagacaggaggugacgauugggucaaagacacuaaguucaucauuguuuuugcgcuaacgcggggcaauaaaaucgugaaggcuucugggaagaugucaaacaguggaagcaaacgccucauggcccugcaggaaaaguauggccuuguagagcgagcagaaacccgucuguccauuacaccugugagagucgcccagucuuugccaacuuggaccugcgcugcagccgcugcccucaaagaguaccugccggugggucccgcgguuaugaaucugaagguggagaacuauccuccagaaaugauguguauggcauucgggucgcucauccccacagccggagucucagaggcuaccacuaaaacauuaauggaagccuacagccuguggcaggaugcauuuaccaagacgauaaaugugaagaugaggggcgcuaguaaaacugagguauauaacuccuuccgggacccucuucacgccgcgguuaauucuguguuuuucccaaacgauguccgcgugaagugguugaaagccaagggcauccuggggcccgacggagugccuagcagagcagcugaagucgccgcugccgcauacaggaaucuaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17477 - RNA, 3604 nt, Artificial Sequence
  mRNA product Design2 comprising derived and/or modified sequence from SFTSV(HB29)__NC_018138.1__GP (opt3)
ggggcgcugccuacggagguggcagccaucuccuucucggcaucaagcuuaccaugaugaaggugaucugguucagcucccugauuugccucgucauacaguguucuggcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggacaagggugcggcccaaauguuacggcuucagucgcaugauggccacccuggaggucaacccuccagaacagcgaaucggacaaugcacuggcugucaccuugagugcaucaaugggggagugagauugauuacacugaccagcgagcuaagguccgcuacgguuugugccucucauuuuugcucgagcgcguccucagguaagaagaguacugaaauacacuuccacucuggcagccucguggggaaaaccgcaauccaugucaagggagcccugguggacggcacagaguucacuuuugaagguuccuguauguuccccgaugggugcgacgcuguagauugcaccuuuugucgggaguuccuuaaaaacccgcagugcuauccugccaagaaauggcuguuuauuaucauaguuauuuugcucggcuacgcaggacugauguuacugacaaaugugcucaaggcuaucggcgucugggggucaugggugaucgcccccgucaaacuuauguucgcgauuaucaagaagcugaugcguaccgugagcuguuugguuggaaaacuaauggaccgcgguagacaggugauucacgaagagauaggcgagaacggggaaggaaaucaagaugacguaaggaucgagauggcccggccacgacgcgucagacauuggauguauucuccugugauucugacgauccucgcaaucggccuggcugaagguugcgaugagaugguucacgccgacuccaaacuugugaguuguaggcaggggagcggcaacaugaaggagugcauuacuacaggacgggcucuguugcccgccgucaauccaggccaggaagcaugucuccauuuuaccgcccccgggucuccugauuccaagugccugaagauaaaagugaagcgcaucaacuuaaaauguaagaaaucaaguagcuacuucguaccagacgcuagaucgaggugcacuuccgugcgucggugucgaugggcgggagauugccagucuggcugcccgccccacuuuacaagcaauucauucagugacgacugggcagguaagauggauagagccgggcugggauuuuccggcuguucugacgguugcggcggggcugccuguggaugcuucaacgcagccccuagcuguaucuuuuggaggaaguggguugagaauccacacggcauuauuuggaaagucucccccugcgcugccugggugccuucagcagugaucgaacuaaccaugccaagcggggagguccgcacguuccaucccaugaguggaauaccgacccaaguuuucaagggcgugucugugacauaucucgguuccgauauggaaguaagcgggcugacugaccuuugugagaucgaggaauugaaaucgaagaaacuggcgcucgcuccuugcaaccaggccggaaugggcgucguggguaagguuggcgagauucaguguucaucugaagagagugcacggaccaucaaaaaggaugggugcauuuggaacgccgaccuggugggaaucgaacuuagagucgaugacgcuguguguuacuccaagauaacaagcguugaggccguggcaaauuauucugcuauuccaacuaccaucggcgggcugagguuugagcgcagccacgauucccagggaaaaauuucaggcagucccuuggacaucacagccauacgagguagcuucucuguaaacuaccgggggcuccgucuguccuuaucagaaaucaccgcgacuugcacgggagaggucacaaaugugaguggcugcuacagcuguaugaccggugccaagguguccauuaaacugcauucuucgaagaacagcacugcucacgucagaugcaaaggcgaugaaaccgcauuuucaguucuagagggggugcacuccuauaucguaaggcucaguuucgaccaugccguggucgaugaacaaugucagcugaauugcggaggccacgagucucaggugacacuuaaggggaacuugauuuuucuggacguuccuaaguucguggacggaagcuacaugcagaccuaucauuccacuguccccacaggcgcuaauaucccaucaccuacggauuggcucaacgcccuguuugguaauggguuaucucgcuggauacugggagugauuggcguucuuuugggcgggcucgcacuguucuuucuaaucauguuccugcucaaacugggaaccaagcaaguguuucggagcagaacuaaacuugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17478 - RNA, 3601 nt, Artificial Sequence
  mRNA product Design2 comprising derived and/or modified sequence from SFTSV(HB29)__NC_018138.1__IgE-leader_Gn-Gc (opt3)
ggggcgcugccuacggagguggcagccaucuccuucucggcaucaagcuuaccauggacuggaccuggauccuguuccucguggccgcugcaacaagaguccacagcgacucagggcccaucauuugcgccggaccuauccacaguaacaaaagcgcugguauuccacaucuucugggcuacuccgagaagaucugucaaauagauagauugauccacguuucuucgugguuaaggaaucauucacaguuucagggguaugugggacagcggggcggucgcagccaaguaaguuacuauccggcagaaaacuccuacucucgauggagcgggcugcuaucccccugcgacgccgauuggcucggaaugcugguggucaaaaaggcgaaagagucagacaugauugugccuggcccaaguuauaagggcaagguuuucuuugaacgucccaccuucgauggguacgugggaugggguuguggcagcgggaaaucuagaacagaguccggagaacuuugcucaagcgacaguggcacuucuuccggucuguugccuagcgauaggguccucuggaucggggacguggcuugucagccaaugacgcccauuccugaggagaccuuucuggaacugaagucguucucucaguccgaguuuccagauaucugcaaaauagacggaauuguauucaaucagugugaaggcgagucacucccgcaacccuuugauguugccuggauggacgugggccacagucauaagaucauuaugcgggagcacaaaacaaaguggguccaggaaagcuccucuaaggauuucgugugcuauaaagaggggacuggaccuuguagcgaaucagaggaaaaggcaugcaaaaccagugguuccugccgcggcgacaugcaguuuuguaagguggccgggugcgagcacggagaggaagcuagcgaggcaaaauguagaugcucuuuaguccauaagccaggcgaaguugugguaucauacggugggacaagggugcggcccaaauguuacggcuucagucgcaugauggccacccuggaggucaacccuccagaacagcgaaucggacaaugcacuggcugucaccuugagugcaucaaugggggagugagauugauuacacugaccagcgagcuaagguccgcuacgguuugugccucucauuuuugcucgagcgcguccucagguaagaagaguacugaaauacacuuccacucuggcagccucguggggaaaaccgcaauccaugucaagggagcccugguggacggcacagaguucacuuuugaagguuccuguauguuccccgaugggugcgacgcuguagauugcaccuuuugucgggaguuccuuaaaaacccgcagugcuauccugccaagaaauggcuguuuauuaucauaguuauuuugcucggcuacgcaggacugauguuacugacaaaugugcucaaggcuaucggcgucugggggucaugggugaucgcccccgucaaacuuauguucgcgauuaucaagaagcugaugcguaccgugagcuguuugguuggaaaacuaauggaccgcgguagacaggugauucacgaagagauaggcgagaacggggaaggaaaucaagaugacguaaggaucgagauggcccggccacgacgcgucagacauuggauguauucuccugugauucugacgauccucgcaaucggccuggcugaagguugcgaugagaugguucacgccgacuccaaacuugugaguuguaggcaggggagcggcaacaugaaggagugcauuacuacaggacgggcucuguugcccgccgucaauccaggccaggaagcaugucuccauuuuaccgcccccgggucuccugauuccaagugccugaagauaaaagugaagcgcaucaacuuaaaauguaagaaaucaaguagcuacuucguaccagacgcuagaucgaggugcacuuccgugcgucggugucgaugggcgggagauugccagucuggcugcccgccccacuuuacaagcaauucauucagugacgacugggcagguaagauggauagagccgggcugggauuuuccggcuguucugacgguugcggcggggcugccuguggaugcuucaacgcagccccuagcuguaucuuuuggaggaaguggguugagaauccacacggcauuauuuggaaagucucccccugcgcugccugggugccuucagcagugaucgaacuaaccaugccaagcggggagguccgcacguuccaucccaugaguggaauaccgacccaaguuuucaagggcgugucugugacauaucucgguuccgauauggaaguaagcgggcugacugaccuuugugagaucgaggaauugaaaucgaagaaacuggcgcucgcuccuugcaaccaggccggaaugggcgucguggguaagguuggcgagauucaguguucaucugaagagagugcacggaccaucaaaaaggaugggugcauuuggaacgccgaccuggugggaaucgaacuuagagucgaugacgcuguguguuacuccaagauaacaagcguugaggccguggcaaauuauucugcuauuccaacuaccaucggcgggcugagguuugagcgcagccacgauucccagggaaaaauuucaggcagucccuuggacaucacagccauacgagguagcuucucuguaaacuaccgggggcuccgucuguccuuaucagaaaucaccgcgacuugcacgggagaggucacaaaugugaguggcugcuacagcuguaugaccggugccaagguguccauuaaacugcauucuucgaagaacagcacugcucacgucagaugcaaaggcgaugaaaccgcauuuucaguucuagagggggugcacuccuauaucguaaggcucaguuucgaccaugccguggucgaugaacaaugucagcugaauugcggaggccacgagucucaggugacacuuaaggggaacuugauuuuucuggacguuccuaaguucguggacggaagcuacaugcagaccuaucauuccacuguccccacaggcgcuaauaucccaucaccuacggauuggcucaacgcccuguuugguaauggguuaucucgcuggauacugggagugauuggcguucuuuugggcgggcucgcacuguucuuucuaaucauguuccugcucaaacugggaaccaagcaaguguuucggagcagaacuaaacuugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17479 - RNA, 1120 nt, Artificial Sequence
  mRNA product Design2 comprising derived and/or modified sequence from SFTSV(HB29)__NC_018137.1__N (opt1)
ggggcgcugccuacggagguggcagccaucuccuucucggcaucaagcuuaccaugagcgaguggucccgcaucgccguggaguucggcgagcagcagcugaaccucaccgagcuggaggacuucgcccgggagcuggcguacgaggggcucgaccccgcccugaucaucaagaagcugaaggagaccggcggggacgacugggucaaggacacgaaguucaucaucguguucgcccucacccgcggcaacaagaucgugaaggccagcgggaagauguccaacagcggcuccaagcggcugauggcccugcaggagaaguacggccucgucgagcgcgcggagacccggcugagcaucaccccggugcgcguggcccagucccugcccacguggaccugcgccgccgcggccgcccucaaggaguaccugcccgucgggcccgccgugaugaaccugaagguggagaacuacccgcccgagaugaugugcauggccuucggcagccucauccccaccgcgggggucuccgaggccaccacgaagacccugauggaggccuacagccuguggcaggacgccuucaccaagaccaucaacgugaagaugcggggcgccuccaagacggagguguacaacagcuuccgcgacccccuccacgcggccgucaacuccguguucuucccgaacgacgugcgggucaaguggcugaaggccaaggggauccugggccccgacggcgugcccagccgcgccgccgagguggcggccgccgccuaccggaaccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17480 - RNA, 3604 nt, Artificial Sequence
  mRNA product Design2 comprising derived and/or modified sequence from SFTSV(HB29)__NC_018138.1__GP (opt1)
ggggcgcugccuacggagguggcagccaucuccuucucggcaucaagcuuaccaugaugaaggugaucugguucagcucccugaucugccucgucauccagugcagcggcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcacccggguccgcccgaagugcuacggguucagccggaugauggcgacccuggaggugaacccgcccgagcagcgcaucggccagugcacggggugccaccucgagugcaucaacggcggggugcggcugaucacccugaccuccgagcuccgcagcgccaccgucugcgccucccacuucugcagcuccgccagcuccggcaagaaguccacggagauccacuuccacuccggcagccugguggggaagaccgccauccacgucaagggcgcgcugguggacgggaccgaguucaccuucgagggcuccugcauguuccccgacggcugcgacgccguggacugcacguucugccgggaguuccucaagaacccccagugcuaccccgccaagaaguggcuguucaucaucaucgucauccugcucggguacgccggccugaugcugcucaccaacgugcugaaggccaucgggguguggggcagcugggucaucgcgcccgugaagcugauguucgccaucaucaagaagcucaugcgcaccguguccugccuggucgggaagcugauggaccggggccgccaggugauccacgaggagaucggcgagaacggggagggcaaccaggacgacgugcggaucgagauggcccgcccccgccggguccgccacuggauguacagcccggugauccucaccauccuggccaucgggcuggccgagggcugcgacgagauggugcacgcggacuccaagcucgucagcugccggcagggguccggcaacaugaaggagugcaucacgaccggccgcgcccugcugcccgccgugaaccccgggcaggaggccugccuccacuucaccgcccccggcagcccggacagcaagugccugaagaucaaggugaagcggaucaaccugaagugcaagaaguccagcuccuacuucguccccgacgcgcgcagccggugcaccuccgugcgccggugccgcugggccggggacugccagagcggcugcccgccccacuucacguccaacagcuucuccgacgacugggccgggaagauggaccgggccggccucggcuucagcgggugcuccgacggcugcgggggcgcggccugcgggugcuucaacgccgcccccagcugcaucuucuggcgcaaguggguggagaacccccacggcaucaucuggaaggucucccccugcgccgcgugggugccgagcgccgugaucgagcugaccaugcccuccggcgagguccggaccuuccaccccaugagcgggauccccacccagguguucaagggcguguccgucacguaccuggggagcgacauggagguguccggccucaccgaccugugcgagaucgaggagcucaagagcaagaagcuggcccuggccccgugcaaccaggccggcauggggguggucggcaaggugggggagauccagugcagcuccgaggagagcgcgcgcaccaucaagaaggacggcugcaucuggaacgccgaccugguggggaucgagcugcgggucgacgacgccgugugcuacuccaagaucaccagcguggaggccgucgccaacuacuccgcgauccccacgaccaucggcggccuccgcuucgagcggagccacgacucccaggggaagaucagcggcagcccccuggacaucaccgccauccgcgggagcuucuccgugaacuaccggggccugcgccucagccuguccgagaucaccgccacgugcaccggggaggugaccaacgucagcggcugcuacuccugcaugaccggcgccaaggugagcaucaagcugcacuccagcaagaacuccaccgcgcacgugcgcugcaagggggacgagacggccuucagcguccucgagggcgugcacagcuacaucgugcggcuguccuucgaccacgccgucguggacgagcagugccagcugaacugcgggggccacgagagccaggugacccucaaggggaaccugaucuuccuggacguccccaaguucguggacggcuccuacaugcagaccuaccacagcaccgugccgacgggcgccaacauccccucccccaccgacuggcucaacgcccuguucgggaacggccugagccgcuggauccucggggucaucggcgugcugcugggcgggcucgcgcuguucuuccugaucauguuccuccugaagcugggcaccaagcaggucuuccggucccgcaccaagcucgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17481 - RNA, 3601 nt, Artificial Sequence
  mRNA product Design2 comprising derived and/or modified sequence from SFTSV(HB29)__NC_018138.1__IgE-leader_Gn-Gc (opt1)
ggggcgcugccuacggagguggcagccaucuccuucucggcaucaagcuuaccauggacuggaccuggauccuguuccucguggccgccgcgacccgcguccacagcgacuccgggcccaucaucugcgccggcccgauccacagcaacaaguccgccgggaucccccaccuccugggcuacagcgagaagaucugccagaucgaccgccugauccacguguccagcuggcugcggaaccacucccaguuccagggguacgugggccagcgcggcgggcggagccaggucuccuacuaccccgcggagaacagcuacucccgcuggagcggccugcucucccccugcgacgccgacuggcuggggaugcugguggugaagaaggccaaggagagcgacaugaucgucccgggccccuccuacaaggggaagguguucuucgagcggcccaccuucgacggcuacgugggcugggggugcggcagcgggaagucccgcaccgagagcggcgagcucugcagcuccgacagcggcacguccagcgggcugcugcccuccgaccggguccucuggaucggcgacguggccugccagccgaugacccccauccccgaggagaccuuccuggagcucaagagcuucucccagagcgaguuccccgacaucugcaagaucgacgggaucguguucaaccagugcgagggcgagucccugccgcagcccuucgacgucgccuggauggacguggggcacagccacaagaucaucaugcgcgagcacaagaccaagugggugcaggaguccagcuccaaggacuucgucugcuacaaggagggcacgggccccugcagcgaguccgaggagaaggcgugcaagaccagcggguccugccggggcgacaugcaguucugcaagguggccgggugcgagcacggcgaggaggccagcgaggccaagugccgcugcucccuggugcacaagcccggggaggucguggugagcuacggcggcacccggguccgcccgaagugcuacggguucagccggaugauggcgacccuggaggugaacccgcccgagcagcgcaucggccagugcacggggugccaccucgagugcaucaacggcggggugcggcugaucacccugaccuccgagcuccgcagcgccaccgucugcgccucccacuucugcagcuccgccagcuccggcaagaaguccacggagauccacuuccacuccggcagccugguggggaagaccgccauccacgucaagggcgcgcugguggacgggaccgaguucaccuucgagggcuccugcauguuccccgacggcugcgacgccguggacugcacguucugccgggaguuccucaagaacccccagugcuaccccgccaagaaguggcuguucaucaucaucgucauccugcucggguacgccggccugaugcugcucaccaacgugcugaaggccaucgggguguggggcagcugggucaucgcgcccgugaagcugauguucgccaucaucaagaagcucaugcgcaccguguccugccuggucgggaagcugauggaccggggccgccaggugauccacgaggagaucggcgagaacggggagggcaaccaggacgacgugcggaucgagauggcccgcccccgccggguccgccacuggauguacagcccggugauccucaccauccuggccaucgggcuggccgagggcugcgacgagauggugcacgcggacuccaagcucgucagcugccggcagggguccggcaacaugaaggagugcaucacgaccggccgcgcccugcugcccgccgugaaccccgggcaggaggccugccuccacuucaccgcccccggcagcccggacagcaagugccugaagaucaaggugaagcggaucaaccugaagugcaagaaguccagcuccuacuucguccccgacgcgcgcagccggugcaccuccgugcgccggugccgcugggccggggacugccagagcggcugcccgccccacuucacguccaacagcuucuccgacgacugggccgggaagauggaccgggccggccucggcuucagcgggugcuccgacggcugcgggggcgcggccugcgggugcuucaacgccgcccccagcugcaucuucuggcgcaaguggguggagaacccccacggcaucaucuggaaggucucccccugcgccgcgugggugccgagcgccgugaucgagcugaccaugcccuccggcgagguccggaccuuccaccccaugagcgggauccccacccagguguucaagggcguguccgucacguaccuggggagcgacauggagguguccggccucaccgaccugugcgagaucgaggagcucaagagcaagaagcuggcccuggccccgugcaaccaggccggcauggggguggucggcaaggugggggagauccagugcagcuccgaggagagcgcgcgcaccaucaagaaggacggcugcaucuggaacgccgaccugguggggaucgagcugcgggucgacgacgccgugugcuacuccaagaucaccagcguggaggccgucgccaacuacuccgcgauccccacgaccaucggcggccuccgcuucgagcggagccacgacucccaggggaagaucagcggcagcccccuggacaucaccgccauccgcgggagcuucuccgugaacuaccggggccugcgccucagccuguccgagaucaccgccacgugcaccggggaggugaccaacgucagcggcugcuacuccugcaugaccggcgccaaggugagcaucaagcugcacuccagcaagaacuccaccgcgcacgugcgcugcaagggggacgagacggccuucagcguccucgagggcgugcacagcuacaucgugcggcuguccuucgaccacgccgucguggacgagcagugccagcugaacugcgggggccacgagagccaggugacccucaaggggaaccugaucuuccuggacguccccaaguucguggacggcuccuacaugcagaccuaccacagcaccgugccgacgggcgccaacauccccucccccaccgacuggcucaacgcccuguucgggaacggccugagccgcuggauccucggggucaucggcgugcugcugggcgggcucgcgcuguucuuccugaucauguuccuccugaagcugggcaccaagcaggucuuccggucccgcaccaagcucgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17482 - RNA, 1120 nt, Artificial Sequence
  mRNA product Design2 comprising derived and/or modified sequence from SFTSV(HB29)__NC_018137.1__N (opt5)
ggggcgcugccuacggagguggcagccaucuccuucucggcaucaagcuuaccaugagcgagugguccagaaucgccguggaguucggcgaacagcaacugaaccucaccgaacuggaggacuuugcucgggaacuugccuacgaggggcuggaucccgcgcucauuaucaagaaacugaaggagacaggaggcgacgauugggucaaagacacgaaguucauuaucguuuuugcucuuacccgcgggaauaaaauugugaaggccucuggaaagaugagcaacuccggcucuaaaagacugauggcccuccaggaaaaguaugggcugguggagcgggcugaaacacgccugagcaucaccccugucagaguggcccagucccucccgacauggaccugcgcugccgcggccgcucugaaagaguaccuucccguuggaccugccgugaugaaucugaaggucgagaacuaucccccugaaaugauguguauggcuuucggcucucucauccccacagccggcgugagcgaggcgaccacgaaaacccugauggaagccuacucccuuuggcaggaugcuuuuacaaagaccauuaauguuaagaugcgcggggccagcaaaacagagguguauaacucuuuccgggacccucugcacgcugccgucaauuccguguuuuucccgaacgaugugagagucaaguggcucaaagccaagggaauccugggccccgacgggguuccuagccgggcugcggaaguggccgcugccgccuaccgcaaucugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17483 - RNA, 3604 nt, Artificial Sequence
  mRNA product Design2 comprising derived and/or modified sequence from SFTSV(HB29)__NC_018138.1__GP (opt5)
ggggcgcugccuacggagguggcagccaucuccuucucggcaucaagcuuaccaugaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaggcuucugaagccaaaugucggugcucccuggugcauaagccuggggaaguggucgugagcuacggaggcacacgcguuagacccaaauguuacggguucucccggaugauggcgacccuugaggugaacccucccgaacagcgcaucggacaaugcacgggcugucaccuggagugcauuaaugggggcgucagacucaucacccugacaucugagcugcggagcgccaccgugugugcuucccauuuuugcucuagcgccuccagcggaaagaagucuacagaaauucacuuccacuccggcagccucguugggaaaaccgcuauccaugugaagggagcccuggucgacggcacggaguucacauuugaagggucuuguauguuccccgauggaugcgacgcgguggauugcaccuuuugucgcgaguuccuuaaaaacccucagugcuauccggccaagaaauggcuguuuaucauuaucgucauucuccugggcuacgcugggcuuaugcugcucacaaaugugcugaaggccaucggcguuuggggauccugggugauugcucccgucaagcugauguucgccaucaucaaaaagcucaugagaaccgugagcugucugguuggcaaacuuauggaccgggggagacaggugauucacgaagagaucggagagaacggcgaagggaaucaagaugacguccgcauugagauggcccggccuagacgcgugcggcauuggauguauucucccgugauccugaccauucucgcuaucggacuggcggaaggcugcgaugagaugguucacgccgacagcaagcuggucuccuguagacaggggagcggcaacaugaaagagugcauuacaacgggacgcgcucugcucccugccgugaaucccggccaggaagccugucugcauuuuaccgcuccggggucuccugauuccaagugccugaagaucaaagugaagcggaucaaccucaaauguaagaaaagcuccucuuacuucguccccgacgccagaagccgcugcacauccgugcggagaugucgcugggcgggagauugccagucuggcugcccuccccacuuuaccagcaauuccuucucugacgacugggcugggaagauggaucgggccggacugggcuuuagcggguguuccgacggcugcggaggcgccgcuugugggugcuucaacgccgcuccuagcuguaucuuuuggagaaaguggguugagaauccccacggaauuauuuggaaagugucuccgugcgccgcgugggucccuuccgccgugaucgaacuuacaaugcccagcggcgagguucggaccuuccaucccaugucugggauuccuacgcaaguguucaagggagucuccgugacauaucugggcagcgauauggaaguuucuggccucaccgaccugugugagaucgaggaacugaaauccaagaaacuugcucucgccccgugcaaccaggcugggaugggaguggucggcaaggugggggagauccaguguagcuccgaagagagcgcccgcaccauuaaaaaggauggaugcaucuggaacgcggaccuggugggcauugaacugagagucgaugacgccguuuguuacucuaagaucacaagcguggaggcuguggccaauuauuccgcuauucccaccacaaucgggggacuccgguuugagagaucucacgauagccagggcaaaaucuccggcucuccucuggacauuacggccauccgcgggagcuucuccgucaacuaccggggacuuagacugucucucagcgaaauuaccgccacaugcaccggcgaggugacaaauguuuccgggugcuacagcuguaugaccggagcuaaggugucuaucaaacugcauuccagcaagaacucuacggcgcacguccgcugcaaaggcgaugaaaccgccuuuuccgugcuggaggggguucacagcuauauugugagacuuuccuucgaccaugcugucguggaugaacaaugucagcucaauugcggaggccacgagucucagguuacacugaagggcaaccugaucuuucucgacgugcccaaguucgucgacgggagcuacaugcagaccuaucauuccacagugccuaccggagccaauauccccagcccuacggauuggcugaacgcccuuuuuggcaaugggcugucucgguggauucucggagugaucggcguccugcuugggggacuugcucucuucuuucugauuauguuccugcucaaacugggcacaaagcaaguuuuucgcuccagaaccaaacuugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17484 - RNA, 3601 nt, Artificial Sequence
  mRNA product Design2 comprising derived and/or modified sequence from SFTSV(HB29)__NC_018138.1__IgE-leader_Gn-Gc (opt5)
ggggcgcugccuacggagguggcagccaucuccuucucggcaucaagcuuaccauggacuggaccuggauccuguuccucguggccgcugccacaagaguccacagcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaggcuucugaagccaaaugucggugcucccuggugcauaagccuggggaaguggucgugagcuacggaggcacacgcguuagacccaaauguuacggguucucccggaugauggcgacccuugaggugaacccucccgaacagcgcaucggacaaugcacgggcugucaccuggagugcauuaaugggggcgucagacucaucacccugacaucugagcugcggagcgccaccgugugugcuucccauuuuugcucuagcgccuccagcggaaagaagucuacagaaauucacuuccacuccggcagccucguugggaaaaccgcuauccaugugaagggagcccuggucgacggcacggaguucacauuugaagggucuuguauguuccccgauggaugcgacgcgguggauugcaccuuuugucgcgaguuccuuaaaaacccucagugcuauccggccaagaaauggcuguuuaucauuaucgucauucuccugggcuacgcugggcuuaugcugcucacaaaugugcugaaggccaucggcguuuggggauccugggugauugcucccgucaagcugauguucgccaucaucaaaaagcucaugagaaccgugagcugucugguuggcaaacuuauggaccgggggagacaggugauucacgaagagaucggagagaacggcgaagggaaucaagaugacguccgcauugagauggcccggccuagacgcgugcggcauuggauguauucucccgugauccugaccauucucgcuaucggacuggcggaaggcugcgaugagaugguucacgccgacagcaagcuggucuccuguagacaggggagcggcaacaugaaagagugcauuacaacgggacgcgcucugcucccugccgugaaucccggccaggaagccugucugcauuuuaccgcuccggggucuccugauuccaagugccugaagaucaaagugaagcggaucaaccucaaauguaagaaaagcuccucuuacuucguccccgacgccagaagccgcugcacauccgugcggagaugucgcugggcgggagauugccagucuggcugcccuccccacuuuaccagcaauuccuucucugacgacugggcugggaagauggaucgggccggacugggcuuuagcggguguuccgacggcugcggaggcgccgcuugugggugcuucaacgccgcuccuagcuguaucuuuuggagaaaguggguugagaauccccacggaauuauuuggaaagugucuccgugcgccgcgugggucccuuccgccgugaucgaacuuacaaugcccagcggcgagguucggaccuuccaucccaugucugggauuccuacgcaaguguucaagggagucuccgugacauaucugggcagcgauauggaaguuucuggccucaccgaccugugugagaucgaggaacugaaauccaagaaacuugcucucgccccgugcaaccaggcugggaugggaguggucggcaaggugggggagauccaguguagcuccgaagagagcgcccgcaccauuaaaaaggauggaugcaucuggaacgcggaccuggugggcauugaacugagagucgaugacgccguuuguuacucuaagaucacaagcguggaggcuguggccaauuauuccgcuauucccaccacaaucgggggacuccgguuugagagaucucacgauagccagggcaaaaucuccggcucuccucuggacauuacggccauccgcgggagcuucuccgucaacuaccggggacuuagacugucucucagcgaaauuaccgccacaugcaccggcgaggugacaaauguuuccgggugcuacagcuguaugaccggagcuaaggugucuaucaaacugcauuccagcaagaacucuacggcgcacguccgcugcaaaggcgaugaaaccgccuuuuccgugcuggaggggguucacagcuauauugugagacuuuccuucgaccaugcugucguggaugaacaaugucagcucaauugcggaggccacgagucucagguuacacugaagggcaaccugaucuuucucgacgugcccaaguucgucgacgggagcuacaugcagaccuaucauuccacagugccuaccggagccaauauccccagcccuacggauuggcugaacgcccuuuuuggcaaugggcugucucgguggauucucggagugaucggcguccugcuugggggacuugcucucuucuuucugauuauguuccugcucaaacugggcacaaagcaaguuuuucgcuccagaaccaaacuugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17485 - RNA, 1120 nt, Artificial Sequence
  mRNA product Design2 comprising derived and/or modified sequence from SFTSV(HB29)__NC_018137.1__N (opt11)
ggggcgcugccuacggagguggcagccaucuccuucucggcaucaagcuuaccaugagcgaguggucgcgcauagccguggaguucggcgaacaacaacucaaccuaacagaauuggaagacuucgcacgcgagcuagcguacgagggccuggacccggcccuaaucaucaaaaagcuaaaggaaacgggaggggacgacuggguaaaagacaccaaauucauaauaguguucgcgcuaacgcgcgggaacaagaucgugaaagcgagcggaaaaaugagcaacagcgggagcaagcgccugauggcgcuucaggaaaaguacgggcucguggaacgggccgagaccaggcucucgauaacgcccgugcgcguggcacagagccugcccacguggacaugcgcagccgcagccgcacuaaaagaauaccucccgguagggccagcggucaugaacuugaaaguagaaaacuacccgcccgagaugaugugcauggccuucggcucgcuaauaccaacggccggggucucggaagcgaccacgaaaacacucauggaagcguacucacucuggcaagacgccuucaccaaaaccauaaacguaaaaaugcgaggggccucgaaaacggaaguguacaacagcuuucgcgacccccugcacgcggccgugaacucggucuucuucccgaacgauguaagggucaaguggcugaaagcaaaagggauccugggcccggacggggucccgagcagggccgcggaaguggccgcagccgcguacaggaaccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17486 - RNA, 3604 nt, Artificial Sequence
  mRNA product Design2 comprising derived and/or modified sequence from SFTSV(HB29)__NC_018138.1__GP (opt11)
ggggcgcugccuacggagguggcagccaucuccuucucggcaucaagcuuaccaugaugaaaguaauaugguucucuucccucauaugccuagucauccagugcagcggcgacuccgggcccaucauaugcgcaggccccauccacagcaacaaaucagcagggauaccccaccuccucggauacucagagaaaauaugccaaauagacagauuaauccacgugagcuccuggcugcggaaccacucucaauuccaaggguacgucggucaacgagggggaagaagccaagucucauacuacccagcagaaaacagcuacuccagauggagcggauuacuaucgccuugcgacgcagacuggcuaggcaugcuaguaguaaagaaagccaaagaauccgacaugaucgugccaggccccucuuacaaaggaaaaguauuuuucgaaaggccaacauucgacggauacgucggcuggggcugcggcuccggaaaaagcaggacugagagcggggagcuauguucaucagacagcggcacgucgagcggccuccucccaucagaccggguccuguggaucggagacgucgccugccaacccaugaccccgauaccagaagagacauuccuagagcuaaagagcuucucccaaagcgaguuccccgacauaugcaaaauagacggcauagucuucaaucaaugcgagggagaaucccucccucagccuuucgaugucgcauggauggacguggggcacucacauaaaauuaucaugcgagaacacaaaacgaaauggguccaggaauccagcagcaaagauuucguaugcuauaaagaaggaacaggacccugcucagaaucagaggaaaaagccugcaaaaccucaggcucgugcagaggugacaugcaguucuguaaagucgccggaugcgaacacggggaagaagcaagcgaggccaaaugccgcugcagccuuguccacaagccaggagaaguagucgucuccuacggcggcaccaggguccgccccaaaugcuacggcuucuccagaaugauggccacccucgaagucaacccgcccgaacaacgcaucggacaaugcacaggcugccaccucgaaugcauaaacggcggagugagacugaucacccuaaccuccgagcuccggagcgccaccgugugugcaucccacuucugcagcuccgccucaagcggcaaaaagaguaccgaaauccacuuccacucgggaagccugguaggaaaaacagccauccaugugaaaggagcccucguagacggaacagaguucacauucgaaggaagcugcauguucccugacggcugcgacgccguagacugcaccuuuugccgagaguuccucaaaaacccccaaugcuaucccgccaagaaauggcuuuuuaucauaauuguaaucuugcucggcuacgccggccuaaugcuacucaccaacgugcucaaagccauaggaguaugggggucaugggucaucgccccagugaaacuaauguucgcaauaaucaaaaagcuaaugcgaacgguaucaugccuagucggaaaacuaauggacagaggacgccaaguaauacacgaagaaaucggggagaacggggaggguaaccaggacgacguccgaauagagauggcgaggccccggagagugcgccacuggauguacagcccaguaauacuaaccauucuagccauaggacuggcugaaggaugugaugaaaugguacaugccgauagcaaacugguauccugccggcaaggauccggaaacaugaaggaaugcaucacaacagggagagcccugcuaccggcaguaaacccuggacaagaagcaugccugcacuuuaccgcgccggggagccccgacagcaaaugccucaagauaaaggucaagcgaauaaaccuaaaaugcaagaaaucuagcaguuacuucguaccagacgcaagaagcagaugcaccucaguucgacggugccgcugggccggugacugccaguccggcuguccgccccauuucacgagcaacagcuucagugacgacugggcaggcaaaauggacagagcuggacucggcuucagcggcugcagcgacggcugugggggagcggccugcgggugcuuuaacgcagcaccuagcugcaucuucuggcgaaagugggucgaaaacccacacgggauaauauggaaggucagccccugcgcagcauggguaccauccgccgucauagaauuaacaaugccguccggcgaaguucgcacauuccaucccaugucaggcauaccaacccaggucuuuaaaggcgucucaguaaccuaccuaggaucagacauggagguaagcggacuuacagaccucugugaaauagaggaacucaagagcaagaaacucgcacucgcgccuugcaaccaggcaggcaugggcguagucggcaaaguuggggaaauccagugcucaagcgaagaaagcgcccgcaccaucaagaaagacggaugcaucuggaacgcggaucuagucggaaucgagcuacgcguugaugacgccguaugcuacagcaaaaucaccucaguagaggccgucgcaaacuacuccgccauacccacaacuauaggcggucucagguucgagcgcucccacgacucccagggaaaaauaucaggcucgccccuagacauaaccgccauccgaggcucauucucagucaacuaccgcggccuucgccucagccucuccgaaauuacggcaaccugcaccggagaaguaacgaacgucucagguugcuauucgugcaugaccggagccaaagucagcauaaaacugcacuccagcaaaaacucaacagcgcacguacgaugcaaaggcgacgaaacagcauucucaguacuugaaggaguccacuccuacaucguuaggcuauccuuugaccaugccgucgucgacgaacaaugucaacuaaacugcgggggacacgaaucgcaagugacucuaaaaggaaaccugauauuucucgacgucccgaaauucguagacgggucuuauaugcagacauaccacagcacgguaccaacuggagccaacauaccaucacccacagacuggcugaacgcucuauucggaaacggccucucaagguggauacuaggggucauaggcguucuccuaggaggccucgcacuauucuuccuaaucauguuucugcucaaacucggcacaaagcaaguauucagaagccgaacuaaacuagcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17487 - RNA, 3601 nt, Artificial Sequence
  mRNA product Design2 comprising derived and/or modified sequence from SFTSV(HB29)__NC_018138.1__IgE-leader_Gn-Gc (opt11)
ggggcgcugccuacggagguggcagccaucuccuucucggcaucaagcuuaccauggauuggacguggauacucuuucucguggccgcggccacgcgcgugcacucggacuccgggcccaucauaugcgcaggccccauccacagcaacaaaucagcagggauaccccaccuccucggauacucagagaaaauaugccaaauagacagauuaauccacgugagcuccuggcugcggaaccacucucaauuccaaggguacgucggucaacgagggggaagaagccaagucucauacuacccagcagaaaacagcuacuccagauggagcggauuacuaucgccuugcgacgcagacuggcuaggcaugcuaguaguaaagaaagccaaagaauccgacaugaucgugccaggccccucuuacaaaggaaaaguauuuuucgaaaggccaacauucgacggauacgucggcuggggcugcggcuccggaaaaagcaggacugagagcggggagcuauguucaucagacagcggcacgucgagcggccuccucccaucagaccggguccuguggaucggagacgucgccugccaacccaugaccccgauaccagaagagacauuccuagagcuaaagagcuucucccaaagcgaguuccccgacauaugcaaaauagacggcauagucuucaaucaaugcgagggagaaucccucccucagccuuucgaugucgcauggauggacguggggcacucacauaaaauuaucaugcgagaacacaaaacgaaauggguccaggaauccagcagcaaagauuucguaugcuauaaagaaggaacaggacccugcucagaaucagaggaaaaagccugcaaaaccucaggcucgugcagaggugacaugcaguucuguaaagucgccggaugcgaacacggggaagaagcaagcgaggccaaaugccgcugcagccuuguccacaagccaggagaaguagucgucuccuacggcggcaccaggguccgccccaaaugcuacggcuucuccagaaugauggccacccucgaagucaacccgcccgaacaacgcaucggacaaugcacaggcugccaccucgaaugcauaaacggcggagugagacugaucacccuaaccuccgagcuccggagcgccaccgugugugcaucccacuucugcagcuccgccucaagcggcaaaaagaguaccgaaauccacuuccacucgggaagccugguaggaaaaacagccauccaugugaaaggagcccucguagacggaacagaguucacauucgaaggaagcugcauguucccugacggcugcgacgccguagacugcaccuuuugccgagaguuccucaaaaacccccaaugcuaucccgccaagaaauggcuuuuuaucauaauuguaaucuugcucggcuacgccggccuaaugcuacucaccaacgugcucaaagccauaggaguaugggggucaugggucaucgccccagugaaacuaauguucgcaauaaucaaaaagcuaaugcgaacgguaucaugccuagucggaaaacuaauggacagaggacgccaaguaauacacgaagaaaucggggagaacggggaggguaaccaggacgacguccgaauagagauggcgaggccccggagagugcgccacuggauguacagcccaguaauacuaaccauucuagccauaggacuggcugaaggaugugaugaaaugguacaugccgauagcaaacugguauccugccggcaaggauccggaaacaugaaggaaugcaucacaacagggagagcccugcuaccggcaguaaacccuggacaagaagcaugccugcacuuuaccgcgccggggagccccgacagcaaaugccucaagauaaaggucaagcgaauaaaccuaaaaugcaagaaaucuagcaguuacuucguaccagacgcaagaagcagaugcaccucaguucgacggugccgcugggccggugacugccaguccggcuguccgccccauuucacgagcaacagcuucagugacgacugggcaggcaaaauggacagagcuggacucggcuucagcggcugcagcgacggcugugggggagcggccugcgggugcuuuaacgcagcaccuagcugcaucuucuggcgaaagugggucgaaaacccacacgggauaauauggaaggucagccccugcgcagcauggguaccauccgccgucauagaauuaacaaugccguccggcgaaguucgcacauuccaucccaugucaggcauaccaacccaggucuuuaaaggcgucucaguaaccuaccuaggaucagacauggagguaagcggacuuacagaccucugugaaauagaggaacucaagagcaagaaacucgcacucgcgccuugcaaccaggcaggcaugggcguagucggcaaaguuggggaaauccagugcucaagcgaagaaagcgcccgcaccaucaagaaagacggaugcaucuggaacgcggaucuagucggaaucgagcuacgcguugaugacgccguaugcuacagcaaaaucaccucaguagaggccgucgcaaacuacuccgccauacccacaacuauaggcggucucagguucgagcgcucccacgacucccagggaaaaauaucaggcucgccccuagacauaaccgccauccgaggcucauucucagucaacuaccgcggccuucgccucagccucuccgaaauuacggcaaccugcaccggagaaguaacgaacgucucagguugcuauucgugcaugaccggagccaaagucagcauaaaacugcacuccagcaaaaacucaacagcgcacguacgaugcaaaggcgacgaaacagcauucucaguacuugaaggaguccacuccuacaucguuaggcuauccuuugaccaugccgucgucgacgaacaaugucaacuaaacugcgggggacacgaaucgcaagugacucuaaaaggaaaccugauauuucucgacgucccgaaauucguagacgggucuuauaugcagacauaccacagcacgguaccaacuggagccaacauaccaucacccacagacuggcugaacgcucuauucggaaacggccucucaagguggauacuaggggucauaggcguucuccuaggaggccucgcacuauucuuccuaaucauguuucugcucaaacucggcacaaagcaaguauucagaagccgaacuaaacuagcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17488 - DNA, 62 bp, Artificial Sequence
  5'-UTR of human peroxisomal multifunctional enzyme type 2 lacking the 5'-terminal oligopyrimidine tract (HSD17B4)
gtcccgcagtcggcgtccagcggctctgcttgttcgtgtgtgtgtcgttgcaggccttattc

SEQ ID NO: 17489 - RNA, 62 nt, Artificial Sequence
  5'-UTR of human peroxisomal multifunctional enzyme type 2 lacking the 5'-terminal oligopyrimidine tract (HSD17B4) mRNA
gucccgcagucggcguccagcggcucugcuuguucgugugugugucguugcaggccuuauuc

SEQ ID NO: 17490 - DNA, 42 bp, Artificial Sequence
  5'-UTR of human acid ceramidase lacking the 5'-terminal oligopyrimidine tract (ASAH1)
gcctctgctggagtccggggagtggcgttggctgctagagcg

SEQ ID NO: 17491 - RNA, 42 nt, Artificial Sequence
  5'-UTR of human acid ceramidase lacking the 5'-terminal oligopyrimidine tract (ASAH1) mRNA
gccucugcuggaguccggggaguggcguuggcugcuagagcg

SEQ ID NO: 17492 - DNA, 75 bp, Artificial Sequence
  5'-UTR of human mitochondrial ATP synthase subunit alpha lacking the 5'-terminal oligopyrimidine tract (ATP5A1)
gcggctcggccattttgtcccagtcagtccggaggctgcggctgcagaagtaccgcctgcggagtaactgcaaag

SEQ ID NO: 17493 - RNA, 75 nt, Artificial Sequence
  5'-UTR of human mitochondrial ATP synthase subunit alpha lacking the 5'-terminal oligopyrimidine tract (ATP5A1) mRNA
gcggcucggccauuuugucccagucaguccggaggcugcggcugcagaaguaccgccugcggaguaacugcaaag

SEQ ID NO: 17494 - DNA, 54 bp, Artificial Sequence
  5'-UTR of mouse RIKEN cDNA 2010107E04 gene (Mp68, 2010107E04Rik)
ctttcccattctgtagcagaatttggtgttgcctgtggtcttggtcccgcggag

SEQ ID NO: 17495 - RNA, 54 nt, Artificial Sequence
  5'-UTR of mouse RIKEN cDNA 2010107E04 gene (Mp68, 2010107E04Rik) mRNA
cuuucccauucuguagcagaauuugguguugccuguggucuuggucccgcggag

SEQ ID NO: 17496 - DNA, 81 bp, Artificial Sequence
  5'-UTR of mouse NADH dehydrogenase (ubiquinone) 1 alpha subcomplex, 4 (Ndufa4)
gtccgctcagccaggttgcagaagcggcttagcgtgtgtcctaatcttctctctgcgtgtaggtaggcctgtgccgcaaac

SEQ ID NO: 17497 - RNA, 81 nt, Artificial Sequence
  5'-UTR of mouse NADH dehydrogenase (ubiquinone) 1 alpha subcomplex, 4 (Ndufa4) mRNA
guccgcucagccagguugcagaagcggcuuagcguguguccuaaucuucucucugcguguagguaggccugugccgcaaac

SEQ ID NO: 17498 - DNA, 108 bp, Artificial Sequence
  5'-UTR of mouse nitric oxide synthase interacting protein (Nosip)
ctcctgtcgggcggaagtaggaggagtagagtttaaaaacagtactctttttccggttcgggacgtagttgaagcaacgacaagccggataaccgctcttgagacagg

SEQ ID NO: 17499 - RNA, 108 nt, Artificial Sequence
  5'-UTR of mouse nitric oxide synthase interacting protein (Nosip) mRNA
cuccugucgggcggaaguaggaggaguagaguuuaaaaacaguacucuuuuuccgguucgggacguaguugaagcaacgacaagccggauaaccgcucuugagacagg

SEQ ID NO: 17500 - DNA, 84 bp, Artificial Sequence
  5'-UTR of mouse ribosomal protein L31 (Rpl31)
cccgtgacccggaagttgtacggctacgcgactttccctcccacaaaccctcgcgcccttcctttcctacttgggcccggcaga

SEQ ID NO: 17501 - RNA, 84 nt, Artificial Sequence
  5'-UTR of mouse ribosomal protein L31 (Rpl31) mRNA
cccgugacccggaaguuguacggcuacgcgacuuucccucccacaaacccucgcgcccuuccuuuccuacuugggcccggcaga

SEQ ID NO: 17502 - DNA, 159 bp, Artificial Sequence
  5'-UTR of mouse solute carrier family 7 (cationic amino acid transporter, y+ system), member 3 (Slc7a3)
gggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactaga

SEQ ID NO: 17503 - RNA, 159 nt, Artificial Sequence
  5'-UTR of mouse solute carrier family 7 (cationic amino acid transporter, y+ system), member 3 (Slc7a3) mRNA
gggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuaga

SEQ ID NO: 17504 - DNA, 102 bp, Artificial Sequence
  5'-UTR of human tubulin beta 4B class Ivb (TUBB4B)
atataagcgttggcggagcgtcggttgtagcactctgcgcgcccgctcttctgctgctgtttgtctacttcctcctgcttccccgccgccgccgccgccatc

SEQ ID NO: 17505 - RNA, 102 nt, Artificial Sequence
  5'-UTR of human tubulin beta 4B class Ivb (TUBB4B) mRNA
auauaagcguuggcggagcgucgguuguagcacucugcgcgcccgcucuucugcugcuguuugucuacuuccuccugcuuccccgccgccgccgccgccauc

SEQ ID NO: 17506 - DNA, 222 bp, Artificial Sequence
  5'-UTR of mouse ubiquilin 2 (Ubqln2)
cggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgcc

SEQ ID NO: 17507 - RNA, 222 nt, Artificial Sequence
  5'-UTR of mouse ubiquilin 2 (Ubqln2)  mRNA
cggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgcc

SEQ ID NO: 17508 - DNA, 57 bp, Artificial Sequence
  3'-UTR of human proteasome subunit beta 3 (PSMB3)
ccctgttcccagagcccacttttttttctttttttgaaataaaatagcctgtctttc

SEQ ID NO: 17509 - RNA, 57 nt, Artificial Sequence
  3'-UTR of human proteasome subunit beta 3 (PSMB3) mRNA
cccuguucccagagcccacuuuuuuuucuuuuuuugaaauaaaauagccugucuuuc

SEQ ID NO: 17510 - DNA, 121 bp, Artificial Sequence
  3'-UTR of human caspase 1 (CASP1)
aataaggaaactgtatgaatgtctgtgggcaggaagtgaagagatccttctgtaaaggtttttggaattatgtctgctgaataataaacttttttgaaataataaatctggtagaaaaatg

SEQ ID NO: 17511 - RNA, 121 nt, Artificial Sequence
  3'-UTR of human caspase 1 (CASP1) mRNA
aauaaggaaacuguaugaaugucugugggcaggaagugaagagauccuucuguaaagguuuuuggaauuaugucugcugaauaauaaacuuuuuugaaauaauaaaucugguagaaaaaug

SEQ ID NO: 17512 - DNA, 137 bp, Artificial Sequence
  3'-UTR of human cytochrome c oxidase subunit 6B1 (COX6B1)
actggctgcatctccctttcctctgtcctccatccttctcccaggatggtgaagggggacctggtacccagtgatccccaccccaggatcctaaatcatgacttacctgctaataaaaactcattggaaaagtgaga

SEQ ID NO: 17513 - RNA, 137 nt, Artificial Sequence
  3'-UTR of human cytochrome c oxidase subunit 6B1 (COX6B1) mRNA
acuggcugcaucucccuuuccucuguccuccauccuucucccaggauggugaagggggaccugguacccagugauccccaccccaggauccuaaaucaugacuuaccugcuaauaaaaacucauuggaaaagugaga

SEQ ID NO: 17514 - DNA, 353 bp, Artificial Sequence
  3'-UTR of mouse GNAS (guanine nucleotide binding protein, alpha stimulating) complex locus (Gnas)
gaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagca

SEQ ID NO: 17515 - RNA, 353 nt, Artificial Sequence
  3'-UTR of mouse GNAS (guanine nucleotide binding protein, alpha stimulating) complex locus (Gnas) mRNA
gaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagca

SEQ ID NO: 17516 - DNA, 133 bp, Artificial Sequence
  3'-UTR of mouse NADH dehydrogenase (ubiquinone) 1 alpha subcomplex, 1 (Ndufa1)
ggaagcattttcctggctgattaaaagaaattactcagctatggtcatctgttcctgttagaaggctatgcagcatattatatactatgcgcatgttatgaaatgcataataaaaaattttaaaaaatctaaa

SEQ ID NO: 17517 - RNA, 133 nt, Artificial Sequence
  3'-UTR of mouse NADH dehydrogenase (ubiquinone) 1 alpha subcomplex, 1 (Ndufa1) mRNA
ggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaa

SEQ ID NO: 17518 - DNA, 70 bp, Artificial Sequence
  3'-UTR of human ribosomal protein S9 (RPS9)
gtccacctgtccctcctgggctgctggattgtctcgttttcctgccaaataaacaggatcagcgctttac

SEQ ID NO: 17519 - RNA, 70 nt, Artificial Sequence
  3'-UTR of human ribosomal protein S9 (RPS9) mRNA
guccaccugucccuccugggcugcuggauugucucguuuuccugccaaauaaacaggaucagcgcuuuac

SEQ ID NO: 17520 - RNA, 6 nt, Artificial Sequence
  mRNA 5'-end
gggaga

SEQ ID NO: 17521 - RNA, 6 nt, Artificial Sequence
  mRNA 5'-end
aggaga

SEQ ID NO: 17522 - RNA, 99 nt, Artificial Sequence
  mRNA 3'-end A75-histoneSL
aaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 17523 - RNA, 102 nt, Artificial Sequence
  mRNA 3'-end U3-A75-histoneSL
uuuaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 17524 - RNA, 178 nt, Artificial Sequence
  mRNA 3'-end A154-histoneSL
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 17525 - RNA, 181 nt, Artificial Sequence
  mRNA 3'-end U3-A154-histoneSL
uuuaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 17526 - RNA, 101 nt, Artificial Sequence
  mRNA 3'-end N2-A75-histoneSL
agaaaaaaaaaaaaaaaaaaaaaaaaaaaaaaaaaaaaaaaaaaaaaaaaaaaaaaaaaaaaaaaaaaaaaaaaaaacaaaggcucuuuucagagccacca

SEQ ID NO: 17527 - RNA, 99 nt, Artificial Sequence
  mRNA 3'-end histoneSL-A75
caaaggcucuuuucagagccaccaaaaaaaaaaaaaaaaaaaaaaaaaaaaaaaaaaaaaaaaaaaaaaaaaaaaaaaaaaaaaaaaaaaaaaaaaaaa

SEQ ID NO: 17528 - RNA, 124 nt, Artificial Sequence
  mRNA 3'-end histoneSL-A100
caaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 17529 - RNA, 170 nt, Artificial Sequence
  mRNA 3'-end histoneSL-A146
caaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 17530 - RNA, 136 nt, Artificial Sequence
  mRNA 3'-end N8-A64-N5-C30-histoneSL-N5
agauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17531 - RNA, 131 nt, Artificial Sequence
  mRNA 3'-end N8-A64-N5-C30-histoneSL
agauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccacca

SEQ ID NO: 17532 - RNA, 105 nt, Artificial Sequence
  mRNA 3'-end N8-A64-N5-C4-histoneSL
agauuaauaaaaaaaaaaaaaaaaaaaaaaaaaaaaaaaaaaaaaaaaaaaaaaaaaaaaaaaaaaaaaaaaugcaucccccaaaggcucuuuucagagccacca

SEQ ID NO: 17533 - RNA, 115 nt, Artificial Sequence
  mRNA 3'-end N8-A64-N5-C14-histoneSL
agauuaauaaaaaaaaaaaaaaaaaaaaaaaaaaaaaaaaaaaaaaaaaaaaaaaaaaaaaaaaaaaaaaaaugcaucccccccccccccccaaaggcucuuuucagagccacca

SEQ ID NO: 17534 - RNA, 134 nt, Artificial Sequence
  mRNA 3'-end N6-A64-N5-C30-histoneSL-N5
agaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17535 - RNA, 129 nt, Artificial Sequence
  mRNA 3'-end N6-A64-N5-C30-histoneSL
agaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccacca

SEQ ID NO: 17536 - RNA, 103 nt, Artificial Sequence
  mRNA 3'-end N6-A64-N5-C4-histoneSL
agaucuaaaaaaaaaaaaaaaaaaaaaaaaaaaaaaaaaaaaaaaaaaaaaaaaaaaaaaaaaaaaaaaaugcaucccccaaaggcucuuuucagagccacca

SEQ ID NO: 17537 - RNA, 113 nt, Artificial Sequence
  mRNA 3'-end N6-A64-N5-C14-histoneSL
agaucuaaaaaaaaaaaaaaaaaaaaaaaaaaaaaaaaaaaaaaaaaaaaaaaaaaaaaaaaaaaaaaaaugcaucccccccccccccccaaaggcucuuuucagagccacca

SEQ ID NO: 17538 - RNA, 128 nt, Artificial Sequence
  mRNA 3'-end A64-N5-C30-histoneSL-N5
aaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17539 - RNA, 123 nt, Artificial Sequence
  mRNA 3'-end A64-N5-C30-histoneSL
aaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccacca

SEQ ID NO: 17540 - RNA, 97 nt, Artificial Sequence
  mRNA 3'-end A64-N5-C4-histoneSL
aaaaaaaaaaaaaaaaaaaaaaaaaaaaaaaaaaaaaaaaaaaaaaaaaaaaaaaaaaaaaaaaugcaucccccaaaggcucuuuucagagccacca

SEQ ID NO: 17541 - RNA, 107 nt, Artificial Sequence
  mRNA 3'-end A64-N5-C14-histoneSL
aaaaaaaaaaaaaaaaaaaaaaaaaaaaaaaaaaaaaaaaaaaaaaaaaaaaaaaaaaaaaaaaugcaucccccccccccccccaaaggcucuuuucagagccacca
